United States Patent 11,261,218 (SPECIES OF GENUS PSEUDOMONAS) - sequence listing, part 4

SEQ ID NO: 2 - DNA, 6381510 bp, Candidatus Pseudomonas metallosolvens (residues 4,786,135-6,381,510 of 6,381,510)
  misc_feature (4887461)..(4887560): n is a, c, g, or t
  misc_feature (5925964)..(5926063): n is a, c, g, or t
  misc_feature (6184509)..(6184608): n is a, c, g, or t
  misc_feature (6372068)..(6372234): n is a, c, g, or t
cttgccttcgaactcgtcgaacagctcgcgcgggttcttgccgaaggtgttgaccagcacgttcagacggccacggtgggccatgccgatgacgacttccttggtgccgtaggaaccggaacgctggatcagttcgtcgagcatcggaatcaggctttcgccgccttccagaccgaaacgcttggtgcccgggtatttggtgcccaggtatttttccaggccttcaccggcagtcacgcgctcaagcagatggctcttgatgtcggcggagtacgtcggacgaccacgcacgctttccagacgctgctggaaccactggcgctgctcggaatcggtgatgtgcgtaaattcagcgccgatggtgcggcaatatgtctgctgcaacgcttcgtgaatttcgcgtaggctcgcttcctctttgccgatgaacaggtcgccggcacggaaggtcgtatcaagatcggcattggtcaagccgtaatgattgatcgacaggtctgcaggtgcaggacgctgccacagccccagcgggtcaagctgggctgcctggtggccacgcatacggtaggcctggatcaatcgcagcacttcaacttgcttcttctcgtgctcactgctcacgctgccggcggaaaccggttgagcgcggcgctggttctttgccagcagcacgaaatgatcgcgaattgtcgagtgcgaaacatcagtggcagagttgccgtcggcaggcaacttctgaaagtaggtgcgccactcttctggcacagcgttagggtcgtgcaggtagagctcataaagctcttccacataggcagcgtttccacctgaaaggtaggcgctgttccacatgcgctgcatcacgctttcttgcatgcttggtcaccctcggttaggggaacaccatcgatgtcgacaccgagcaaacttgcagaagtccgaatgcagcgactaaaacaagccacttaggatcacactgatagtccgggtaccagcccggatgcccctgcttgtctcatttcttcaaaataagagccgcagcttatggctactgctctggttatagccatgacgcgggttgaagcccgcgccacagcctctacggtacagcggttacagcagctgaatcacacgccgcttgaaagcagcatgttacggatgtgaccgatggccttagtcgggttcaggcctttcggacatacgttgacgcagttcatgatgccccggcagcggaatacgctgaacgggtcatcgagcgaagccagacgctcgttggtcttggtgtcacggctgtctgccaggaagcgataagcttgcagcagtgcagctggacccaggaacttgtccgggttccaccagaaggacgggcaagaggtcgagcagcaagcgcacaggatgcactcgtacagaccgtcgagcttttcgcgctcttctggcgactgcagacgctcgatggccggagccggcgtgtcgttctgcaggtaaggcttcaccttctcgtattgcttgtagaagatgctcatatcgacaaccaggtcacggataaccggcaaacctggcagcggacgaacgatcaacttgttaccttttacaacggcagacagcggcgtgatgcacgccagaccgttcttgccgttgatgttcatgccgtcggagccgcagacgccttcacggcaagagcgacgataggagaaaccctcgtcctgctctttgatcagggccagcacgtccagcaccatcaggtctttaccaccggtatcgacctggaattcctgcatgaacggcgcagcgtcctgatcagggttgtagcgataaacactcacttgcaacatggcggtcacccttaataagtccggactttaggttcgaaagtcggaacagtcttcggcgagaagttcacggcacgcttggtgacgcgcttgtcacccgggaagtacagggtgtggcacagccagttttcgtcgtcacgatcttcgaagtcttcacgggcgtgagcgccgcgcgactctttacgtacttcggccgcgatggcggtagcttcagccacttccagcaggttttgcagttccagcgcttcgatacgggcagtgttgaacgcctgcgacttatcgttgatcttcacgttggcaatgcgggcacgcaggtcagcgagctgagcgatacctttctgcatgtattcgccggtacggaatacgccgaagtagttctgcatgcagctttgcagctcgcgacgcagggtagcgacgtcttcgccgtcagtacggctgttcagcgcgttcagacgcgacagggcagcctcgatgtcggcttcggtagcgtcgtcgtattcgatgccgtcggtcagcgctttttccaggtgcagaccagcagcgcggccgaataccaccaggtcgagcagcgagttgccgcccagacggttggcaccgtgaaccgatacgcaagccacttcacctaccgcgaacagaccaggaatgatctgatccacgccgtcggcgttctgggtgatcgcctggccgtgaatgttggtggcaacgccgcccatcatatagtggcaagtcggaacaaccggaaccggcgcaacaaccgggtcaacgtgagcgaaagtcttcgacagttcgcagatgcctggcagacggctgtgcagcacttcctcgcccaagtggtcgagtttgagcattacgtggtcgccattcggaccgcaaccgttgccggcgatgatttctttaaccatcgagcgagcaaccacgtcacgaccggcaaggtctttggcgttcggagcataacgctccatgaaacgctcgccgtgcttgttgatcaggtaaccaccttcaccacggcaaccttctgtaaccagtacaccggcgccggcgatgccggtcgggtggaactgccacatttcgatgtcttgtaccggcacgccagcacgcagagccatgccgacgccgtcaccggtgttgatcagggcgttggtggtggaagcgtagatacgaccggcaccgccggtagccaatacagtggctttcgcgcggatgtaggaagtttcgccagtttcgatgcagatcgcgatcacaccgacgaagtcgccttcctggtttttcaccaggtcgacagcgtagtactcgttcaggaacgtggtaccggctttcaggttgccctgataaagggtgtgcagcagtgcgtgaccggtacggtcggaagcagcgcaagtacgcgcagcctggccgcctttaccgtagtccttggactgaccaccgaatggacgctggtagatgcggccttgctcggtacgcgagaacggcagacccatgtggtccagttcgaaaactgcagccgggccttcctgacacatgtattcgatagcgtcctggtcaccgatgtagtcggagcccttgacggtatcgtacatgtgccagcgccagtcatcgttcgggtcagcggacgcgatggcacaagtgatgccgccctgggcggatacagtgtgcgaacgggtcgggaaaaccttggtgatcacggcagtcttgtgaccgccctgtgccagttgcagcgcagcgcgcatgccggcaccgccaccaccaataatgatggcgtcgaaagaaatcgttggaatgttagccatgactcagataccccagagaatctgcacaccccagacgaagtaagcgaacatcgcaacgccgcatactgcctggaaaaggaaacgtactgcagtcgcggacttgcccagcgccattggcgtcaggtagtcggtcgcgatggtccacatgccgacccaggcgtgagcgccaagggcaacgagggccagcagactgaagatacgcatcccgttgtgagcgaacaggccgtgccactggtcgtagccaatgcccggattcgctgcaaggtatccgatcaggaagatgaaataagccgcgagaacaaccgcagacacacgttgcgccatccagtcatagaggcccgaacgcgaaaggttcgtaacgctggttaccatatccaaactcctgccagaacgatcaacaccacggaaacggcgatgataattttcgagcccaggcggccgccttccagcgtctcaccgatgcccatgtccatgatcaagtggcgcacaccggctaccaggtgatacagcagagcggacaggaggccccatgctacgaacttggccagcgggctggtcaagcatgccttcacttcggcaaaaccttcctcggaacccagagatttgcccaatgcataaagcatgaagccgatacccaggaagaggatgatgccggaaacacggtgaagaaacgacgtaacgccggtgatggggagtttgatggtccttaggtctaggtttacaggtcgttggcttttcacggcttttttttcacactgaagagcccctaacaatcagggcaaagttgttggggagtgcactggtcaggtaaccaccacccagggatgcgacccccaataaagcaggcccaaaagcccctggcggtcggtggccgagtatagacagttaggctactaatgacaacgcaatcacctacccccaatagctgattgcacaagttgcataaaaggcgtaaatggcagtcaatttcgaggaaaaagagcgcttaaagccttctggagcaagactttaggcaaattgacattcgaatttatctcactatagtggtgcgggccctgcgtggggggtctgtctgatggttcaagcataaataggaggccacatggctgacaaaaaagcgcagttgatcatcgagggcgcagcccccgtcgagctgcccattttaaccggcaccgttggtcccgatgttattgatgttcggggcctgacggccacgggccgcttcactttcgacccgggtttcatgtcgaccgcctcgtgcgaatcgaagattacctatatcgacggcgacaacggcattctgttgcaccgcggctacccgatcgaacagctggctgaaaagtcggactacctggaaacctgctatctgctgctcaacggcgaactgccgaccgcagaacagaaggcccagttcgtcagcaccgtgaaaaaccacaccatggttcacgagcagctgaaaaccttcttcaacggcttccgtcgtgacgcccacccgatggccgtcatgtgcggtgtagtcggcgccctctcggccttctaccacgactccctcgacatcaataacccgcagcatcgcgaaatctccgcgatccgtctggttgccaagatgccgactctggcagcgatggtttacaagtactccatgggccaacccatgatgtacccgcgcaacgacctgacgtacgcggaaaacttcctgcacatgatgttcaacaccccgtgcgagatcaaaccgatcagcccggtgctcgccaaggctatggaccggatcttcatcctccatgctgaccacgagcagaacgcatcgacttccaccgtgcgtctggccggctcttcgggcgccaacccgttcgcctgtatcgccgccggtatcgccgcactgtggggccctgcccacggcggtgcgaacgaagccgtgctgaccatgcttgacgagattggcgatgtttcgaacatcgacaagttcatcgccaaggccaaggacaagaacgatccgttcaaactgatgggcttcggtcaccgcgtttacaagaaccgcgatcctcgcgcgactgtaatgaagcagacctgcgacgaagtactcaaggaactgggcatcaacaacgatccgcaactcgaactggccatgcgcctggaagagatcgccctgaccgacccgtacttcatcgagcgctcgctgtacccgaacgtcgacttctactcggggatcatcctcaaggcgatcggcattccgaccagcatgtttactgtgattttcgcgctggcacgtactgttggctggatttcgcactggaaagagatgctctccagcccgtacaagattggccgtccgcgccagttgtacactggttacgagtcgcgtgatatttccaagctggaagaccgtaaataagacctgtcttgcgataacgtcttaagttgtaccgggaacggcctctatttatataggggccgtttttgtttgtctggggttttggggttttggggattggggttgggggcatatccgttgctgcgggtgctgccgctggcggtttcgctcttacagcgagtcactttttccaaacgccggagtgccggcccagcgaaaagtaaccaaaaaggcttgcccctgcgtacggcacttcgctgaggctcagtgttccctcgctacggtgtccatccgggggcatcgcctacggtttgcttcgctgcacctcctctcgatgaatgcggcttcgccgcacggcgctgcgcgcctacccccggatgaacacctccgctcggcctgccgatggggcaaaaaatcaaaagccaaagccaagccaaagccaaagccaaagccaaagccaaagccaaagccaaagccaaagccaaagccaaagccaaagccaaagccaaagcaagatcacaagccagatcaagagcccctcaccctagccctcccgaaacgtcggaccgcccgtagggagaggggactgatcgcgatgtttgggggaggtacgcccacgtgaaataccgagtcgaactcagattctgaaacagatcaaaagcccctcaccctaaccctctcccggagggagaggggactgaccgcgtggactggaagagctacgccgatgtgcgataccgtgttgaactcaaattctgaaaagcccacaaatcggccccctctccctcgggagagggctggggtgaggggcagcaacaacgcaaatcaaaagccgaacatccgcccttaaccactcaataggccgagtgtcagctcgcctgctcttgatcttgatccacgggcgacgtcggaaggctgagtggagggattgatccgggcgtgggagcgcagcgaccgtttggcgcagccaaacacagcgagaggaggtgcagcgcagcaaaccgtaggcgctgcgcccggatcgatcccggagcgaaggaaccccgagccccagcgagcgggccgcacgtaggagcaagcgttttttgcttacttttttttcgcgcttgaaaaaaagtgagtcgccgtaagggcgaaaccctaatcagccgttaccgcagcaacggatatacacccaataaaaaacacaccaaagtccgataaccgcccacaaaaaatgccccgatctctcaaccggggcattcagcacaacatttacaaaaccatcaaaccatcaatgcgaaaccgccccgctcgcccccaacccagtctgcgaacgcacaaactgcgggaagaacagcgcccgctctttgtccgctgccgccgacttgtcagtgatcgagaataaccagatccccacaaaggcaatgatcatcgagaacagcgccgggtactcgtaagggaagatcgccttctcatgatgcagaatctgcacccagatggtcgggccgaggatcatcaggcccaccgcactcaccagacccaaccagccgccaatcatcgcgccacgggtggtcagcttcttccagtacatcgaaagcagcagtaccgggaagttacagctcgccgcgatcgagaacgccaagccaaccatgaacgcaatgttctggctttcaaacaggatgcccaagccgatcgccaacaccgccaaggcaatggtggtgatcttcgaaacgcgaatctcgtccttctcgttcgccttgcccttcttgatcacactggcatacaggtcgtgagaaaccgccgaagcaccggccagcgtcaggcccgccacaaccgccagaatggtcgcgaacgccaccgccgagataaagccgaggaagatactgccaccgaccgcgttggccaggtgcaccgccgccatgttgttgccgcccaacagcgcgccagccgcatctttgaaggccgggttagtgctgaccagcaggatcgcgccgaagccgatgatgaaggtcaggatgtagaagtaaccaatgaagccagttgcgtagagcacgctcttgcgggcttcttttgcgtcactcacggtgaagaagcgcatcagaatgtgtggcaggccagcagtaccaaacatcagcgccagacccagcgagaaggccgaaatcggatccttgaccagaccgcccgggctcatgatcgcttcgcccttggcgtgaaccttgatcgcttcggagaacaatgtgttgaagtcaaagcctacgtgcttcatcaccatcagcgccatgaacgaggcaccggacagcaacagcacagccttgatgatctgcacccaggtggtcgccagcatgccgccgaacagcacgtacatgcacatcagcacgccaaccagaatcacggcaacgtggtagtccagaccgaacaacagctgaatcagcttgccggcaccaaccatttgcgcaatcaggtagaacgccaccaccaccagcgaaccgcaggcagacagggtgcgaatctgggtttgcccgaggcggtaggacgccacgtcggcaaaggtgtatttacccaggttacgcagacgctcggcgatcagaaacagaatgatcggccagcccaccaggaagccgatcgagtagatcaggccatcgtagccggaggtgaacaccagcgcggaaatccccagaaaggacgccgccgacatgtagtcaccggcaatcgccagaccgttctggaaaccggtgatcttgccgcccgccgcatagtagtcggccgcggagttgtttttcttcgaggcccagtaggtgatgtagagcgtcgcaccgacgaacgccacgaacatcaggatcgcaggaatattcagtggctgtttggccacctctcccgtcaacgcgtcagccgcccagacacccggtgcgaacgctgcaacgctcaataaagccagtagacgccggatcattgctgagcctccttgagaatcgcattgttcaggtcgtcaaactcgccattggcgcggcgcacgtagataccggtcaggatgaaggcagacagaatcagcccgacaccgatcgggataccccaggttatggatgattcaggactgatcttcgcgcccagaatatgcggcccgtaagcaatcagaaggatgaatgcggagtaaagcccgagcatgattgccgagagaatccaggcgaatcgttcccttttctgaaccagctccttgaatcggggactgttttgaatcgagaggtaaatgctgtcgttcattgtttttatcctcgcagcacaaattattgttggaacatagctaatgtatgcggctgcgggagcgggaacagacgaccttagtagtagaacgccatgacgtattcgccattcttcggtacacccaaaacaactgtaggagtgagcctgctcgcgatggcgtcgtatcagtcgacattttcatcaactgacaggacgctatcgcgagcaggctcactcctacagaggtacggcggtgttgcttttatttggtccagtcagccacgcgatccgggtgcttggcgacccaatccttggccgctgcgtcaggcttggcaccgtcctgaatcgccagcatcacttcgccgatttcgtctttcgacgcccactggaagttcttcaggaacttggccacttccggcgccttggtcgccagttctttgctgccgatgctgttcacggtttcagctgcgccgtacacgcctttcgggtcgtcgaggaagcgcagtttccacttggcgaacatccagtgcggcacccaaccggtgacggcgatggattcgtttttcttctcggcacgggtcagttcggcaatcatgccggcgccggaactggctttgagcgaatacttgtcgaggccgtaatccttgatcgcctgatcggtcttgagcattacgcctgaaccggcgtcgatgccgacgatacggtttttgaaggtgtcatcggttttcaggtcttcgatcgacttggctttcacatactccggcacgatcaggccgatttttgcatccttgaagttcgggccgtagtcgacgaccagatccttgtttttcgtccagtattcaccgtgagtcacaggcagccaggccgagagcatggcgtcgagtttgccggtggcaacgccctgccacatgatcccggtggcgacggcttgcagcttaacgtcgtagccgagtttctgtttgatcacttcggccgccacgtgggtggtcgcgacgctgtcggaccagccgtcaacgtaaccgatgttcagggtctgtttttctgcgctggcgaaagtggagctcatcgcaagcaccagagcggcacctgcgcctaaaagtcgtcgcatcttcatcgttacttccccgaaatgctgcgcccgacggatgccgggcatcgtcaacgtattgttatggtgcacagcgcccccatcacgcctgaccgcaaaccaactcgaacatcagcggagtactgatgccttgatcatcaacctgacgcctcaggcgacctgctctgtcagcgacctcaaggcaacgagaaacgacatcagaaggccattaatcgcggctttataaatgacgccaaataatccgcccgaactttgcatgtgcaaatcatgcaggccaccaacctctctataaatgcaggtaacatgcgtcgctttgcagccactcggcccgaccatgtccgcgacgtcccgctttcctttccctgcttatttatttgcctgcctgctgggcctgtttgccctcggtggcttctggtacggcctcggcaaaccggtgatactgccggacgctgcgacgccgacgcacaagctacaatgcgcgtcctacacgccgttcgacaaagaccaatcgccgttcgacgtgccattcaagctgcgccccgagcgcatggacgccgacctcgcattgctggcgacacgctttgagtgcattcgcacttattcaatgaccggcctggaagcgctgccggatctggcgcgcaaacacggtttgaaattgatgatcggcgcctgggtcaacagcaacccggtggacaccgagaaagaagtcgacctgctgatcgcctcggccaacgccaacccggacgtggtcagcgcggtgatcgtcggcaacgaagccttgctgcgcaaagaagttaccggcacgcaactggtccgcctgatcaacaaggtcaagagccagatcaagcaaccggtcacttacgccgacgtctgggagttctggctcaagcatccggaagtcgcgccagcagtggacttcctgaccattcacttattgccgtactgggaagatgacccgtcaaacatcgacgcagctctgcaacatgtcgcgcaagttcgccaggtgttcggcaataaattcgcgcccaaagacgtgatgatcggcgaaaccggctggccgagcgaaggccgccagcgtgagaccgccctgccgagccgggtcaacgaggccaaattcattcgtggttttgtcgcaatggccgagcaagaaggctggcattacaacctgatcgaagcgtttgaccagccgtggaagcgcggcagtgaaggcgcggtcggtggctattgggggctgtttgatgcggatcgtcaggacaaaggcgtactcgccgggccggtaaccaatgtgccgttctggaaggaatggctggcggttggtggtttgattttcctcggcacactgatccttggcggtcgcgttcgcaccacgcgctcggcgctggtgttgccgctgctgggcgccctcggcgcttgctcgattggcgcctggggtgatctggcgcgagtgaccacaaggtttaccggcgaatggctgtgggtcggcttgctgacagcgttgaacctgttggtgttggcacatgcggcgctggcgctcagtgcgcgtactggctggcgtcaacgtgcgttcaatctgctggagcggcgtgccggctggctggttgcggcggcaggttttgctgcggcggtgatgatgctcgagatggtcttcgatccgcgttatcgcagctttgccagcatggcgttcgtgctgccggcgctggcttatctgtgccgtccggtgagtgtgccgcgtcgcgaaattgctctgctgacgtttattgttggtgcggggattgcgccgcagttgtatcaggaagggttgcagaatcagcaggcgtggggctgggcgttggtgagtggcttgatggtggctgctttgtggcgctgcctgcgcgttcacaagatttaatattcatcgactgaaatgcccaatcgcgagcaggctcactcctacagtttggaatgcgttccccttgtaggagtgagcctgctcgcgatagctgacgatcaggcgctacgggactcgcggaccaaccgcaacccggcaatcaccaacgcaaacaccgccaacgtcgtgttgtacaacgccagcgccggcaccccgaacaccagcgccagtaccgccagccaccaccctgcccgcccgggcaagacaaaaccgaccaacgccgcccccaacgctgcccagcccaacaccttgaagtgaatcatcaaaccaaggttcgagcgcatctggcattcccagcgactggcctcatccacgcagataccgacccactgcccgtcctccataaagccataccgcgcggcataactggcagccagccacaacggcaacagaacaagcagcaaaatcacgggcaagcggcgggacatgaaacactccaatcttcggaaatcgtcggccagcttaatctgccgccagccgtgtgcaagaactaacaactgttaactgttcattcagtcggtgcaaagtgtatcgtccagctactattactccgaattctgcctgtttggtgccgcagcatggcactttggcgcaaacccggtggtcatagcctgcgaacttcattcggcaccttcctctaagggatctagtcatgctccgttccttgcgcttcgccgcgctgttcagcggccttattttgagtgcgtccgcactggcggtagatatcgatgccgccagttatggctaccccctgaccaacccgttcgaggcgaccatcgccacgacgccgccggacttgcgcccggaattgccgctggacgacgacatcaatcagtcggaccgcagcctgacgttgcgcccggagcgagagttcatcttgccggacaacttctgggcggtaaaaaagcttacctaccgcatcgccacccaggacaagccggcgccgttgatcttcctgatcgcaggcaccggcgcgcgttatgacagcacactcaacgaatacctgaaaaagctctactacaaggccggctaccacgtcgtgcagctgtcgtcgccgaccagtttcgacttcatcagtgccgcctcgcgcttcgccacgccgggcgtgaccaaagaagacgccgaagacatgtaccgggtgatgcaggccgtgcgcgcgcaaaatccgaaagtgccagtgaccgagtattacctgaccggctacagcctcggcgcccttgatgctgcatttgttgcgcacctggacgaaacccgtcgtagcttcaacttcaagaaagtcctgctgctcaatccgccggtgaacctctacacctcgatcaccaacctcgacaaactggtgcaaaccgaagttaaaggtatcaacaccagcaccacgttctatgagttggtgctgagcaagttgactcgctacttccagcagaaaggctacatcgacctcaacgatgcattgctttacgacttccagcagtccaagcagcacctgaccaacgaacagatggcgatgctgatcggcacctcgttccgtttctcggcggccgacattgccttcacgtcggacctgatcaaccgtcgcggcctgatcacgccaccgaaattccccatcaccgaaggcaccagcctcacgccgttcctcaagcgtgcgctgcaatgcgacttcgattgctacctgaccgatcaggtgattccgatgtggcgtgcacgcaccgacggcggcagcctgctgcaactgatcgatcaggtcagcctgtacgcgctcaaggattacctgcacgacagcccgaaaatcgccgtaatgcacaacgccgacgacgtgatcctcggcccgggcgacctcggcttcctgcgcaagaccttcggtgatcgcttgaccgtttatccactgggcggccattgcggcaacattaactatcgcgtcaacagcgacgccatgctggagttcttccgtggctaaatatctcctgctgattgctgcgctcctctgcacaggcgtggtccaggccgacaacagtaaagccaacgcgccggttgtggtcgacagcgacggcttcaaagagccgctgtccaaactcaaattcaacccaggcctggatcaacgcgaattcgagcgttcgacgctcaacgcgctgaacgtctatgacccgctggaatcgtggaaccgccgggtttaccacttcaattaccgcttcgaccaatgggtatttctgccggtggtcgatggctatcgttacgtcacgccaagctttgtgcgcactggggtgagcaacttcttcaataacctcggcgatgtaccgaacctgctgaacagcctgttgcagttcaagggccagcgctcgatggaaaccaccgcacgcctgctgctcaataccaccatcggtattgctggcttgtgggatccggcgaccgccatgggcctgccgcgccagagcgaagacttcggtcagaccctgggcttctatggtgtaccgggtggcgcctacttcgtactgccgatcttcggcccgtcgaatatccgtgataccgcgggtctggccgtggactacaccgccgaatcggcgatcaacttcctcaatgtctcggaagtcagctccaaccatccggaagtctgggccctgcgtgccgtcgacaagcgctaccagaccagcttccgttatggccagatgaactcaccgttcgagtacgagaaggtgcgctacgtgtataccgaggcgcgcaagttgcagatcgccgaatagttttcggcaggtacaaaaaagggccattcgatgcgagtcgaatggccctttttcatggcacaacaaaagatcaaactgtaggagtgagcctgctcgcgatagcggtgtgtcaggcgacacttgtggggctgatacaccgctatcgcgagcaggctcactcctacaagggttttgtgttgaatgtcagtttttcagggccttccagattttgccgacgacagaaaccaccgccaacaccaccgcaccggcaatgatccccgccacaccattaagcaacatcggcaccgcaaacccgacactgccggccgctgcgcctacgccttcaatccagtcatgcaccaccggcacgccgtgggtgaggatgccgccgccgaccaggaacatcgctgccgtaccgaccaccgacagggttttcatcatgtacggtgccgcgctcagaatggcgctgccgactttcttcgcgacctgcccaggcttctgggtcagccacaaaccaagatcgtcgagtttgacgatgcccgccaccaggccataaacgcccaccgtcatcacaatcgcaatgccggacatcacgatcacttgctgcgtcagcgaggcagttgccacggtacccaaggtgatggcgataatctctgccgagaggatgaagtcagtgcgaatcgcgcccttgatcttgtctttctcatacgccaccagatcagtcgccggatcggctaccgcctcagtcagttgcgcatgttcgatctcgtcttctgccttgctgtgcagaaatttgtgcgcgagtttctcgaacccttcgaaacacaagtaagcaccgccaaccatcaacagcggcgtcaccagccatggcacgaacgcactgatcgccagcgccgagggcaccagaatcagcttgttgacgaacgaacccttggccacggcccagaccacaggaatttcccgctcggcacgcacgccggagacctgctgggcgttgagcgccagatcgtcgccgagcacgccggcggtcttcttggcggccattttgctcatcaacgccacgtcgtccagcacggtggcaatatcgtcgaccagcaccagcaaactgcttcctgccatgaatcctgtttccttttatgtatgaatgttgcgaagcataacgcgaccttagaccacgcggggcattcttgagcgtcgcgcgaggccggtgctaccatgcgcaaccgccagaacaggcaaggaaccaccgggtttatgagcacaatccgcgagcgcaacaaagaactgatcctgcgtgccgccagtgaggagtttgccgacaagggcttcgctgcgaccaaaaccagcgacatcgccgccaaggcgggattgcccaagcccaacgtctactactacttcaagtccaaggaaaacctttaccgcgaggtattggaaagcatcatcgtgccgattctgcaggcgtcgacgccgttcaatcccgacggtgtgccgagcgaagtgctgagcggctacatccgctcgaagatccgcatctcccgcgacctgcccttcgcctcgaaagtattcgccagcgaaatcatgcacggcgccccgcacctgagcaccgacctggtcgagcagctcaacggccaggccaagcacaacatcgactgcatccagagctggatcgatcgcggccagatcgccccgatcgaccctaatcacctgatgttcagcatctgggccgcgacccagacctacgccgacttcgactggcagatttctgctgtgacggggaaagagaagctggatgaggcggattacgaagcggcggcgcagacgataatccggttggtgttgaaggggtgtgagccggactgaataccgtagagacgccatcgcgagcaggctcgctcctacaggggaacacattccagatgtaggagtgagcctgctcgcgatcgaggcaactcggttgcagatcaaacccagatggcatcccacagcggatagtcgccaagcttttccaccagcccggcccgcaacgggttagccacgacataacgcgccattttcaccaaatcgtcttcccgcctcaaggcgcggtcatgaaaccctctctgccagagaacgctgtttccaccggaagcttgcctgacagccttggtgctcagcgatttggttttttgcatcacctcactcaatgaacctcgtcgcaattcaatcagccaatggaaatgatctggcatgactacccaggctaatgagctcaccagccccgaatcttgcgcgtgtcgaaattgatcagcgaccaattttcccaaggcaatatccctgaaaatcggctttcgttgataagtggtgctggttaacagatagattcgactgacttcggtatagcgcccgactcgcaatttatgtgcagcaggtagatccggcattcctttgccctctgtgatcaggtcatgaaaaggctagtaccgggaaagacaaatggagcggtcaactgttggctggatgtgtctggtagatagcaatcgcgagcaggctcactcctacaggggatctggggtattcagacattttgtgtcgaaccacaaatccaatgtaggagtgagcctgctcgcgaaagcgattaatcagacgctaaagatcaagcagccacccccgcatccgccctcaactccaacgcctccaccgctttaatcgccacctgctcatcgatatccgacaaatccccgctgatgccgatcgcgcccagcacattccctgcctgatcccgaatcaacacgccacccggtgccggcacgacgctgccctggcccatgctgttgagtgcggcaatgaaggctggccgttgttgcgcgtcgagtgccagcaggcgtgagcctttgcccagcgcgatggcgccccaggctttgccgatggcgatgttcgggcgcagcaggctggcgccgtcttcgcgttgcagggtgatcaggtggccgccggtatcgagtaccgcgatggtcaggggggcggcgttgatgccgcgccctgcgttgatggcttcgttgaccaggttgactgcgactttcaaggttaaagcgctcatggtgccgtcctcattttgttatagggaaagtcgtggggctgcgcttttctgccgcagcccgatgcaacaaatagaacacaatcaattatttttttgtatacaataattctcgaaaagcgccacatgcgacgaaaagccacactcagaaaggcttccgacgaatgaaacaggcgcttgagaaaatggattgacctgcgccgtccgccgtgaatacactctgcgcaaagccacttgtatacaattacaaaacgtaaagaggcacaaaaccatgagcaaaatgagagcaatcgaagccgccgttctggtgatgcgccgtgaaggggttgataccgcttttggcatcccgggcgctgccatcaacccgctgtactccgccttgcagaaagtcggtggcatcgatcacgtccttgctcgccacgttgaaggcgcctcgcacatggccgagggctacacccgcaccaaggccggcaacatcggcgtgtgcatcggtacttccggccctgccggtaccgacatggtcaccgggctctacagcgcctcggccgactcgattccaatcctctgcattaccggccaggcaccccgcgcccgtatgcacaaggaagacttccaggctgtcgacatcaccagcatcgtcaagccagtcaccaagtgggcgaccactgttctggaaccgggccaagtgccttacgcgtttcagaaagcgttctttgagatgcgctccggccgtccaggcccggtgctgatcgacctgccgttcgacgtgcagatggccgagatcgaattcgacatcgacgcctaccagccgctgccattggccaaaccgaccgccacccgcgttcaggtcgagaaggctttggcgctgcttgatcaagccgagcgtccattgctggttgccggcggcggcatcattaatgccgacgccagcgatctgctggttgagttcgctgaactgaccggtatcccggttatcccgaccctgatgggctggggcaccatcccggacgatcacccgttgatggtcggcatggtcggtctgcagacgtcgcaccgttacggcaacgccaccatgctgaaatccgacgtggtgttggggatcggtaaccgttgggccaaccgtcacaccggttcggttgacgtgtacaccgaaggccgcaagttcattcacgtcgacatcgaaggcacgcagatcgggcgtgtgttcacgccggatctgggcatcgtttccgacgctgctgccgcactgaccgtgttcatcgaagtggcccgtgaatggcaagccgccggcaagctgaagaaccgcagcgcctggctgcaagactgccagcagcgcaaagccagcctgcaccgcaagacccacttcgacaacgtgccggtcaaaccacagcgcgtttacgaagaaatgaatcaggtgttcggcaaggacacctgctacgtcagcaccattggtctgtcgcagattgccggcgcgcagttcctgcacgtctacaagccgcgtcactggatcaactgtggccaggccggcccgttgggctggaccattccggcagcgctgggtgtggtgaaggccgatccgagccggaaagtcgtggccctgtcgggggactatgacttccagttcatgatcgaagaactggcggtcggcgctcagttcaaactgccgtacatccacgtcgtggtgaacaactcgtacctgggtctgatccgtcaggcacagcgcgggttcgaaatggactactgcgtgcagctgtccttcgataacctgaacgcgccggaactcaacggttacggtgttgaccacgtcgcagtggctgaaggccttggctgtaaggcgctgcgtgtattcgaaccatcggaaatcgcccctgccctgcgcaaggccgaacagatgatcgaagagttcaaggtgccggtgatcgtcgagatcattctggagcgtgtcaccaacatctccatgggtaccgagatcaacgccgtcaacgaattcgaagacctggcgctggtcggcaacgatgcgccaacggcgatttcgctgcttgattgatcgtaattagctccctctccctccgggagagggctggggtgagggaaaggttttgcggtgatcgcaaaattcggatcagactcaggatccccctcaccctaaccctctcccccaggagaggggactgatcgcgaacattctgaccaaccgtgtcacatccgttttttaggagaccaccatgccgcgtttcgcagccaacctgtccatgctgttcaccgaacaggatttccttgcccgtttcgacgccgccgccaaggctggcttcagcggtgtcgagtacctgttcccgtacgacttcagctctgccgaaatcaaggccaaactcgacgccaacggtctgacccaagtgctgttcaacctgccggccggtgactgggccaagggcgaacgcggtatcgcgtgtttgccggatcgggtcgaagagttccgcgccggtgtcgatctggcgattgcctacgcacaagtgctgggcaacacccagatcaactgcctggccggtatccgtccgcaaggcgttgacgatgccacggtagaaaagaccttcgtcgccaacctgaaatacgccgccgacaagctgcaggcagcgggcatcaaactggtgatggaagcgatcaacacccgcgacatcccgggcttctacctgaacaacacggcgcaagccctgtcgattcgcgagcaggtcggcagcgccaatctgttcctgcaatacgacatttatcacatgcaaatcatggaaggcgatctggcccgcaccctgcaatcgcacctgggcgagatcaaccatgtgcagctcgcggacaacccggggcgcaacgaacccggcaccggtgaaatcaactaccgcttcctgttcgaacacctcgaccgcatcggttatcagggttgggtgggttgcgaatacaagccgctgactaccaccgaagcaggcctcggctggctgaagtcgcacaacgcaatctgacaaacacatgaccctgtaggagctgccgcaggctgcgatcttttgatcttgttattttgaagatcaagatcaaaagatcgcagcctgcggcagctcctacaggggaaagacaaaaacaagaggattttctcatggctaaaatcggatttatcggcaccggcatcatgggccacccaatggcttcgaacctgcagaaagccggtcacagcctgttcctgtcggcgcaccacgacgccgcccctgccgacctggttgccgctggcgccgtcgccctggccaacccgcgcgaagtcgcgcaggaagctgaattcatcatcgtcatggtcccggataccccacaggtcgacgacgtactgttccgcgccgacggcgttgccgctggcctgagcaaaggcaaaatcgtgatcgacatgagctcgatctcgccgaccgccaccaaggcattcgcagcgaagatcaacgaaaaaggcgcgcaatacctcgacgcaccggtatccggtggtgaagtcggcgccaaggccgcgaccctgagcatcatgatcggtggcgacgccgatgccttcgaacgcgcgctgccgctgttccaggccatgggcaagaacatcaccctggtcggtggcaatggcgacggtcaaaccgccaaagtcgccaaccagatcatcgttgccctgaacattcaggccgtcgccgaagccctgctgttcgcttcgaaaaacggtgccgatccagccaaggtgcgtgaagcactgatgggcggtttcgcttcctcgaagatccttgaagtgcacggcgagcgcatgatcaaaggcactttcgatccaggcttccgcatcagcctgcaccagaaagacctgaacctggccctgcaaggcgccaaggagctgaacatcaacctgccgaacaccgccaatgcccagcaagtgttcagcacttgcgcagcgatcggtggcagcaactgggatcactcggcgctgatcaaaggtctggaacacatggccaacttttcgattcgcgacaacaaataagccttcatcaaacctgtaggagtgagcctgctcgcgatgaagtcaccgcggtgagtcagatttaccgcgccgcctggatcgcgagcaggctcactcctacaagggatctgagttgccctttcgaataacaagaattccgggagcccgccatgtcggtcgatccgcaacaactgctgcgcgagctgtttgccacagccatcgacgcggcccatccgaaccaagtcctcgaagcccatttgcctgccgatcgcagcggtcgggtgatcgtcatcggtgccggcaaagccgctgccgccatggcgcaagtggtcgagcgttgctgggagggtgaagtgtctggcctggtggtgacccgttatggtcacggcgccccgtgcgaaaaaatcgaagtggtcgaagccgcgcacccggtgccggacgctgccggcctggccgtggccaaacgtgtgctcgaactggtcagcaacctgactgaagacgaccgcgtgatcttcctgctctccggtggtggctcggccctgctggcgttgccggccgcaggcatcaccctcgccgacaagcagtcgatcaacaaagccctgctcaaatccggcgcgaccatcggcgagatgaactgcgtgcgcaagcacctctcggcgatcaagggcggccgtctcggcaaagcctgctggcctgccactgtttatacctacgcgatttccgatgtcccgggcgacctcgccacggtcatcgcttccggcccgaccgtggccgatccaagcacttccgctgaggcgctggcaatcctcaagcgctacggcatcgagacccctgcttcagtgcgcaactggctgcaaagcccggagtcggaaaccgtcaaacccggtgacccgagcctcgctcgcagccacttccagttgatcgcccgtcctcagcaatcgctggatgccgccgcagtgaaatgccgtcaggccggtttcagcacgctgatcctcggcgacctcgaaggtgagtcgcgcgaagtggcgaaagtccacgccggtatcgcccgccagatcatcaaccacggccagccattggcggcgccgtgcgtgattttgtctggcggcgaaaccaccgtgaccgtgcgcggcaatggccgtggcggacgcaacgccgaattcctcttgagcctcaccgacaacctcaaaggccagcccggcgtctacgcgctggccggtgacaccgacggcattgatggctcggaagacaacgccggagcgatcatgaccccggacagctacgcccgcgccgccgccctcggtttgagcgcgagcgacgagctggataacaacaacggctacggctatttcgcggcgctcgatgcgctgatcgtcaccgagccgacccgcaccaacgtcaacgacttccgcgccattctgatccttgagagctgcaaatcatgacgcctgataaaaaggtcaaaatcctcgccaccctcgggcctgccgtcgacggcatcgaagatatccgtgaactggtcgaggccggggtaaatatcttccgcctgaacttcagccacggcgatcatgccgaccacgccaagcgctatcagtggatccgcgaagtcgagcgccagctcaactacccgctgggcattctgatggacttgcaggggccgaaactgcgcgtcggcaagttcgccgacggcaaggtgcagctgcatcgtggtcaggccttccgtctcgatctggacgcgacaccgggcgatgagcgccgggtcaatctgccgcatccggagatcatcgaagcgctggaagcgggcatggatctgctgctcgacgacggcaaactgcgtctgcgtgtggtcagcaaatacgccgacgcgattgatactaccgtgctcaacggcggcgaactgtcggaccgcaaaggcgtcaacgtaccgcaagcggtgctcgacctcagcccgctgaccgccaaggatcgtcgcgatttgagcttcggtctggaactcggcgtggactgggtcgcgctgtcgtttgtgcagcgcccgcaagacatcgtcgaagcccgcgcactgatcggtgacaaagcctttctgatggcgaaaatcgagaagccttccgccgttgagcaactgcgcgaaatcgctgaattgagcgacgcgatcatggttgctcgtggcgacctcggcgtcgaagtaccggcggaaagcgtgccgcagattcagaaaaacatcatcaccacctgccgcgaactgggcaaaccggtggtggtggcgacgcaaatgctcgagtcgatgcgcttctcccctgccccgacccgtgccgaagtgactgacgttgccaacgccgtggccgaaggtgccgatgcggtgatgctgtcggcagaaaccgcgtccggcgaatacccgctggaagccgtgcagatgatgagcaagatcatccgccaggtggagaacggcccggattatcagactcagctcgacgtcagccggccgaaggcggaagcgaccgtttccgacgcaatcagctgcgcgatccgtcgcatcagcaacgtgctgccggtggcggtgttggtcaactacagcgagtcgggtgcatcgagtttgcgtgcggcgcgggaacggccgaaagcgccgatcctcaacctgacgccgaacctgcaaaccgcgcggcgtctgagcgtggcgtgggggattcattcggtggtcaacgatcgcctgcgtcaggtcgacgaagtctgctcgaccgcgctggaaatcgcccaggcccaaggcatggccgagcgtggcgacacgctgctgatcactgccggcgtgccatttggccagccgggatcgactaactcgctgcggatcgaaacgttgatttaaccgcccaccatgatcgttcccacgctccgcgtgggaatgcggcccgggacgctccgcgtcccaagagcagacgcagagcgtcctttgaggcattcccacgcagacggttcgacgcctcgacgtgggaacgatcagtaccgaatgaactgccatgcctgccaatcatttcaacacccactgccccgactgggccgaggctttgctcaacggtttcagtcaaatattcctccagcgccatccgctgtgcggcctgctgtgtctgttggcgatcctgctgaccgcaccggtgctgttcgccggtgcgctgctcggtgccgtcgccggattgctcaccgcgcaacgccgcaactacgccaaggctgatcgtcaggccggattgttcagctacaacggcatcctgctcggcctgctgctgagcctgtatttcccttggtcgccgctgctgccaccgctgattctcgccgctggcggcttgagcgcgatggtcacgcagcaatggctgaaacacctgtacagcagccgctccataccggcctacacctcgccgttcgtggccatgagctgggtattgctgctgtttgccgaaccttcggcaccgatagcgcacatcgagatgaatacggtcaatctgctcgctgccgaactccgtggactgggccaggtgatgttcctcggccatccgctggccggcgcgctgattgctgccggattgctgatcgctgatcgccgcgcgttttgctgggcgatgctggcttctgcaatcggcctcgcctccagcctgctgcatcacgaaaccagctccgctttgcttggtctcggcagctacaacgcagtgctcgccgccctcgccttctcctcgcaacgccaacaaccgtggctgccgctgaccggcatcgtgttagcgctgctggttacaccgctgtttgctgccgtcggcctcgccactctgaccgcgccattcatcctcgcttgctggctgatccgcgccggcattcagatgcttggcaaagcctcggtcgacaacgcgtcttgcgctcatggggagaatcaacctaggctgcgctgatcttcgattcaggcgttatccatggacagcagcaacaattggcgcgaacggctttacgtgatgattttccagagcgacacccttgccgggcgtcgcttcgacggcatcctgctgttgatcatcctctccagtctggtgatcgtgatgctcgacagcatcgacagcattcaccagaactacgccgacgtgctggcctacatcgaatggggcttcacgatcatctttctcggcgagtacatcctgcgtctgtattgctcaccgaagccgttgcgctacgccttcagcttttacgggctggtggatttgctggcgatcgtgccaggcatcctcgccctgtattacagcgatgcgcagtacctgctgatcattcggatcatccgcatgctgcggattttccgcgtgctcaagctcagcccgtacctcaagcaagccaactatttgatgtcggcgctgcgtggcagcaagcagaaaatcgtggtgtttctggtcagcgtctgcacgctagtgacggtgttcggcaccctgatgtacgtgatcgaaggcccggaacatggcttcaccagcattcccaaaggcatctattgggcgatcgtcacgttgaccaccgtgggcttcggcgacatcgtgccgaagacgccgctgggccaggtgatttcgtcactggtgatgatcaccggttattcgatcatcgccgtgccgacggggatttttaccgccgaactggccaacgccatgcgcggtgaacagctgcaacacgactgcccggtgtgcaagaaaaacagccacgagcatggcgcggcgttctgctcgcgatgtggcaatgccttgttcaagaaactggaataagcaaagagctttttaatctttaaacgactatgcgcgcgccgttatagtcagtggcaattgaacatcaccccctgctcctacacagataaaacaaggaatgcgcagtgaaaaaactctttggcgcctcacttctcgccgccggcctggccttggccaacatcgcccaggcagccccgacgctgctcaacgtttcctacgacgtgatgcgcgatttctacaaggactacaacactgcgttccaaaaacactggcaagccgagcacaacgaaaacatcaccgtgcagatgtccttcggcggttcgagcaagcaagcgcgctcggtgatcgatggcctgccggctgacgtcatcaccatgaacatggccaccgacatcaacgccctcgccgacaacggcaaactggtcccggaaaactgggtcacgcgcctgccgaacaacagcgcgccgttcacttcggccaccgtgttcatcgtgcgcaaaggcaacccgaaagccctgaaagactggccggatctgctcaaggacggcgtgcaagtgatcgtgccaaacccaaaaacctcaggtaacggccgctacacctacctgtcggcctggggttatgtgctgaagaacggcggcgacgagaacaaggccaaggacttcgtcggcaaactgttcaagcaggcgccagtgctggacaccggtggccgcgccgccaccaccacgttcatgaccaaccagatcggcgacgtgctggtgaccttcgaaaacgaagccgaaatgattgcccgcgagtttggtcgtgatcagtttgaagtgatctacccgagtgtttccgctgaagccgagccaccggtgtcggtggtcgacaaagtggtcgacaagaaaggctcgcgtgcggcggcggatgaatacctgaagttcctgtggtcgccggaaggtcaggaaattgcggcggcgaactacctgcgcccgcgtgatccggcggtgttggcgaagtacaccgatcgcttcccgaaagttgacttcctttcggtggagaagacctttggtgactggcgtacagtgcagaagactcacttcaatgatggtggggtttttgatcagatttatagcgggcagtaaggtttaagctgacatgaaaaaggcgatccgcaagggtcgccttttttgtgggcgctttaccctcaccccagccctcccgaaacgtcggaccgcccagagggagagggggccaaccgtgggatgctcaaaagattttccgacctgaaagtgctgctgtgaatccataatcgctgcaagtctttcaggtcgatgtatagcgccagacacctcggtcagtcccctctccctctgggcggtccgacgtttcgggagggctagggtgaggggcttctacatcggcggcgtcaccccgtccttccccgcagaaatcgactgcgccgtcagcgtgccatccgcgctctgcgtcacgaacgtcacaatcttcaccccaaccttcagcaaactccgatcccccggcgtcagattgacgatcggcacatcctccggcaccagtatcttttgctgtccgcccttgtaattcaccgtcagcacccgcccgttgctcaccaccagatcgccgacgctgccattggtcatgctgctgcccttggccagatcgaacggccgatgaccgtcgccgctacccgccagctccggcggaaacacatgcacttccagcgccttgagcgtgccatcttcctggggcattgccgccgaaccaatgtagctgccgggtttgatgtcttcgatattggccagggtgacggcgcgaattttggtgtcgccggtcaagtgaatcaccacgttctcgccgctgttaacgtggactttcaaggtgtcggcgctgaccccggtgatctcgccgcgtacgccgaggcgcatccccggtgcgtcggcggcctgcacgctcatcgcgccgagcaggctgatcagggcaatcgttgcggtgtggcgaagcgtctgacgaaacattgcaatcctccggtcatcaatgttgaacaagccgatgcaaacataagcacgctatcgaacaggatgtaagtgaatgtatcatcgaccctcaacggtcggacgcaaggtccgccgatgaatgacagcagattgcacacggtcattccgcaacggaataactgatatcaaccgccggcgtcttctgcccgcgcggtttgtcccatagcctcactgcattccctttcgctggatcgagaaaccttatgaccaccaccactcacgcaatgacccgaggcatggtgctgctgttcgccttctgctgcggcgccattgttgccaacatctactacgcacagccgataatcggtctgatcgcgccggacatcggtctctccgacaccatggccagcttcatcgtctcgctgacgcagatcggttatgcgctgggcctgttcttcctggtgccgctgggcgatctgctggaaaaccgccggttgatgatcatcaccacgggggtggcgattgccagcctgttggcggcggcgtttaccgatcaaccgaatgtgtttttgctgatctctttgttggtgggcttcagttcggtgtcggtgcagattctgattccactcgcggcgcatttggcgccggaagaatcccgtggccgtgtggtcggcgggatcatgggcggtttgttgctggggattctgttggcgcgaccggtatcgagcgtggttgcagatcacctcggctggcgggcgatgttcatgattgctgcggcactgatggcagcgatcagcgtggtactggcgctgaccgtgcccaagcgccaaccggatcacagcgccacgtatggccaactgcttggctcgttgtggacgctgctgcgccaacaaccggtgctgcgtcaacgtgcgttttatcagggctgcatgttcgccacgttcagcctgttctggacggcagtgccgctggaactggcgcgtaaccatggcctgtcgcaaagcgaaatcgcgatctttgctttggtcggcgccattggtgccatcgccgcaccgatcagcggacgcctggccgacgccggccacacccgcatcgcttcgctgctggccatgctgttcgccagcctgagcttcctgcccgccttcatccacccggcctacagcgtcatcggcctggccgtgaccggcgtggtgctcgacttctgcgtgcagatgaacatggtcctcggtcagcgcgcggtctactcgctggacgcaaagagccgtggtcgtttgaacgcgctgtacatgaccagcatcttcatcggcggcgccttcggctcgtcggtcgccagtgcgttgtatgagcatggcggctggttgtggatcgtgattgtcggcagtgcgttcccgctgttggcattgttgcggtttttgagtgtttcgcagcgtggttcattggcgactgcgtgaagcgtcaaaagcttcgcgagcaggctcgctcccacaggttattcactgagcctgggggagcgaggaagcttaataacgaaccagtttctccattgccgcatccgccagaaaggaggagcggcttttgacgttgtgttcgcgcacataacgatcgatgcgctgaatcacgtaaccgggcagcgtcacgttgaccttctcggtcttgcccagatacggcgaaatgtccagctcgagcatgccccatcccatatcggcaaagtccggattactgcgatgagcagatgccgaagtcggcataggaatcgactccccgtctgccgcgatctcctgcagcatgatgtgggcgacttcaaccgcagccttgtaggcatcttcaaagctatcccctgccgttactgcgccgggaatatcagggatctgaataccgatggcggtattttcatcaccccattcgatgcagattggatattgcattacggatctccttcataactggctggcgggttgtacaacccggcacgcctcctgatgcttttgaccgtccccagtggcaaatcctttttcgggtgaggaacgggaatcgtgtacgggttgtatcggtgcctgaagatgtgatgactgccagtgacccgatccagcgtccagcctgcatcctccaactccttgatcaatagcctgctctgcaccaaccgcctccttgccttggcctcacaaaaataactctagagttatatttactcaagcatagaaattctggaagcgacgcccggttgttttacagaatgtgattgattgcatcgcaaccggacccgattacactcagcggctcacatccaaagccctgaacaatggaagaccagaagggattgttatggcaatggcagtttctaccttcagaacagagtggcttcatcaccgggcagacattgttcgtcgatggcggctcctaggtcggtaaagcctcgttttaatcaatacgactcccctgtaggagtggacgctgccggataacgatgtgtgggcggtttttccgacggggcagatggcgagtgccaaggcaagggcgattgttgagtgtgtccacgggcttctagtgagcaaccattgacgcgtaacgtttcgtttattgcgattttcgtttaattcgaataacgtcccgacattgtcttttcagaaagctggaaaaccatcatgtcgattgttattcatccgccggtcaccctccccgtagagcgcgagatcaaagccgccatcgagggccagcgtgccttggccgcttacctcgctacccaattcgaaacccagcacatacatatcttcgatgagcagaacgaagctcatcgtgtcgagttgccaacgtccgccctgcgcttgcttgctgacattcttacagcgctggcagagggcaacgccgttaaagtcgtgccagtacacgccgaactgaccacccaagaagccgccgacctgctcaacgtctcacgcccgcacatgattaaactgctggaaagtggcgagatttcctaccacaaaaccggcaagcaccgacgtgtgcgctttgccgatctgatggattataagacccggcgtgacagcgccagcgagcaggcaatgatgcttctcgcagagcaggcacaagcgttaaggacaggttacgagtgaggcattcctctttcactgctgtatacgatgcatgtgttttgtacccagccccattgagagactttttgatgtggttagccctctcagggctattccgggcacgatggaccaaggagattcacggcgaatggaaacgcaatctgttgaagaaccgcactgacctgacaatcgagcaattggatcgcacctcggagctgatggatcaggcgattcccgatgcctgcgtctacgactatgaaaatttggtcagtggattgtcattgcccgatctggatgaccgccatgttctggcagcagcgattcgttgcaatgctggcgtgatcgtgacgtttaatttgaaagattttcccgacaaatacctcgcccctttcggtattgaggcgcaacacccggatgagttcgtcgaaaacctgtttcatctggattcggcagccgttgtcgcagccgcgcagcaccaacgcaaacaattgaaaacacccacgatggacgtcgaatcgtttctgagtttgctacaacgtcaggggttgaagaagtcgattcaagcgctcggcagctaccgcgcgatcctgtgaaatcaccagcgcaatcgacagacaaaaaaaggcgatccgaagatcgccgttttcatttactgcccgaatttcttgcccaaccccggtggcacgccgtggatattggtgtcttcccacgggccgttggggctgacggaccggctccagccgttgttccagcggtagtaggtgcgctggcggtagaaggtgttggtctggtcgtcgaggacgtagacgccgagtttctgatcccagtggctgttgccgcccggtggtggggcgaaactggccgaggtgcgcggcacgggtttggccggtttcgccgggatgcttttgcctggggtcggtgacgtcgatggcgtcgggctgggttgtgacggcgggatcggcggcaggttggtggtcggttccgggcgttgcaccgcacatgcactcaagcccagggccagtgtgaggactgtgattcgggcgatggtgtgcatggcggtgctttcctgttgtgtccggctatttgtccgggctgtcgatggtcagtttttgtagcgcagtggtgctgctggccagtgggccgctgcgaccgacccactcgccggcagtcggttggccggcgcgggagatgcgcgcaaccagttggacttcagggaagttcgacagtttcaactgcggcatcattgcgtcggcatcgcccagttcgacggtcactggcagatcggccacggtcaggcgcttggccgccagcggtgccggcgggccggacgtggcgcgggcgaaaatgaacacgctgtcacccggctgcactttgcctttgagctcgctggccagatcgacgctgactttcaacagcgcagtttttgcggctaccggtgcctgagcgactttgccgccactggcttccagacgctcggcggcacgtttgatcccgccttgcagcgcggcgcgggaactgtcctccggcggcagttgcgccagcaagcggttccagtaatcgatggcttgttgataacgctcgccttcgaacgcagcgatgccgagcagaccgaggctggtgacttctttcggatcagccttcagcgcttcgtcggtcaacgcctggatctttgccgaccactttttgccgtcagcaaaatactgcgcctgcgcccattgaccgagcagttccggttgacgtccggccagattggcagcgcgttcgaacatctttgctgcgtccgccggacgctcttgcgccatgtaggtacggccgaggaaatacaggccttcggcagagtccggttgtgccgcgacggcacgctccagacgctgggtcatctcttccatcgactgcggtgcctgggcgaattcgcgggtcagttcgaccttgtcggcagcaccgaaatgcagatacaggcccaggcccaacactggcacaaggactgccgccagcagcggcaatggtttacccagtttcgagatgcgcggtgcggcaaccccttcggtatctgccagcaactcacgcgccgcctcggcgcggccgctgtccatttgcgcagcgtcgagaacgccttcggcctgttgcgcttgcaactcggcgacacgctcctgatacaacgcgacgttcagggcagtccgatcctcttcacgctgggcgcgacgttcgcgcagcaccgggatcagcagaaaactcagggcgaccagaagcaacagccctgcggcaagccagaaatcaatcattcttggtttttatccaacagttggtcgaggcgctgacgctcttcgctggacagcgcttgcggagtttcggcgcgctggccgcgacgacggcggacgatcaccgcgatcaccaccagaccaccgagcagcaggccggccgggccgaaccacagcagcgcagtcttggcgttgagcgccggtttgtagcggacgaaatcaccgtagcgatcaaccatgaaatcgatgatctgctgattgtccttgccttcgccgagcatgcggaaaatctctttgcgcaggtcggcggcaatcggcgcgttggagtcagcgatgtcctggttctggcacttggggcagcgcagctctttggtcagctcgcggaaacgctcacggtcgccttctttggcgaactcgtaggtgtcgatggcggcatgggcgacaccggccagactcaagcccaataccagcgccgctaaaaaacgcttcatggcgtggcctcatcgaccagcgcctgatacttggccgcgagtttttcgcgccagacctgctcgtcgatcacgccgacatacttgtcgcggatgatgcccttggcgtcgatgaagaaggtctccggcgcgccgtagacaccgagattgaggcccagcgagccttcgtcgtcacgaatgtccagcacgtacggattgtggaattcggccagccacttcaaggcatcggcattggtgtccttgtagttgatgccgtagatcaccacgccgcgctcggcgagtttgttcagcaccggatgctcgacccgacaggaaatgcaccaagtaccccagacgttgaccagcgccggtttgccgaggatgtcggccttggtcaggctcttgtcgccctgcacgtttggcagggaaaactccgggaacggcttgttgatcatcgccgacggcaactccgccggatcgaggtacagaccgcgataaagaaataccgccaccagcaggaaaatcgccagtggcaccagcatcaaccaacgtctcatgcagccgctcccgtcatgcccagggcttcacgcaccttggctttcaccttgacccgataacgtcgatccagcgccgccagcaagccaccgaacccggtgagcaaaccgccaaaccagatccagcgcacgaacggtttaacgtgcacccgaaccgcccacgcgccgttgtccagcggctcgcccaatgcgacatacaagtcacgagtgaaaccggcgtcgatgcccgcttcggtcatcaccgagttctgcacggtgtacagacgtttttccgggtgcagcacgctgatttccttgccatcgcgaatgacccgaatggtgcctttgtcggaggtgaagttcggcccttcgaagtgcttggcgccttcgaagacgaagtgataaccggccaggtccatcgactcgcccggcgccagacgcagatcgcgttcggcactgttctgactcgacaacaccacgcccagcgcacacacggcgatgccgaggtgggcaatctgcatgccccaataactgcgggtcaatgttggcaggcctttgatcaggcctttgtgacgggtcttgtcgacgatgtcgcgcacaccagcgagcaacacccaagcggcgagcaggaaggttgcgatcactgcccagttgaaatcgccgtaagcaacaccggcaaccaccgccagcgcaacgctacccaacagcactggggtcagcatgctcgccagccatttcaccggggtgtctttccagcgcacgatcacgccgaccgccatgaccagcatcagcagcgccatcaacggaatgaacagcgcgttgaagtacggcgggccgaccgacattttcgcgccgctgagggcatcgagaatcagcgggtacagggtgccgagcaggatcatcgacgcggccaccaccagcaccaggttgttgcccagcagaagggtttcccgcgaccacaggttgaagccgacctgactcttcacgaccggtgcgcgcagggcgaacaacgtcagcgaaccaccaaccacgaacaacaggaagatcagaatgaacacgccgcgctcgggatcggaggcaaacgcgtgtactgaggtcagtacaccggaacgtacgaggaacgtcccgagcaggctcagtgagaacgcggcaatcgccagcaacaccgtccagctcttgaacacgccacgtttttccgtgaccgccagcgagtggatcagcgcggtgccgaccagccatggcatgaacgaggcgttctccaccgggtcccagaaccaccaaccgccccagccgagttcgtaataggcccaccacgaaccgagggtaatgccgatgccgaggaaggcccaggcgacgatggtccatggacgcgaccagcgtgcccacgccgcatcaagacgaccgcccatcaacgcggcgatggcgaaagcgaaggctaccgaaaaaccgacgtagcccatgtacagcatcggcgggtgaacgatcaggccgatgtcttgcagcagcggattaaggtcagcgccgttactgggcatttgcggcaggatacgtttgaacgggttggacgtgagaatcaggaacagcaggaaaccggtgctgatcatgcccatcaccgccagcacccgcgccagcatgacttgcggcaactgtcgggagaacaccgacaccgcgaaggtccagccgccgaggatcagggcccacagcagcaacgacccttcatgggcgccccacaccgcactgaatttgtaataccacggcaacgcggtgttggagttgttggccacataggcgacggagaagtcgtcggtcatgaacgcgtaggtcagaatgccgaacgcgaacagcaaaaaggcaaactgcccccatgcggccggctgggccagactcatccagaaacggtcaccgcgccatgccccaaccaatggcaccacggcctgcaccagcgcaaagcacagcgccagaatcatcgccaggtggcccaactcaggaataaaaatcgccgacgtcatcaatcaaccctcctttgcaggcgttggtgcggattgaccgctgtctttcaaggctttggtcacttccggcggcatgtatttctcgtcgtgcttggccagcacttcatcggctaccactacgccatcggcgttgatcttgcccagcgccacaataccctgcccttcgcggaacagatccgggaggatgccgcgataggtgatggtcacggatttgttgaagtcggtgacgacgaatttgacgtcgagcgaatccggcgagcgttgcaacgagccggcctcaaccataccgccagcgcggatgcgcgtgtcttgcggtgcttcgccattggcgatctgggtcggggtgtagaacagattgatgttctgctgcagggcgctgagggccaaaccgacggcagcgccgaccccgaccagaatggccagaatgatgatcagacgtttcttgcgcagcggattcacttgccgttctcccggcgcagacgacgcgcctcttgttgcagataccgcttgcgggccaggatcggcgccgccacgttgaaagccagcactgccagacagatgccataggccgaccagacatacaggccatgatggcccatggcgaggaagtcgccgaatgaagcaaaactcatcgagcggcctccaggctgcgctgcacttgttctttcacccaactggcgcgggcttcgcgcttgagtacttcgaggcgcatgcgcagcaacagcacggtgccgaagaagcagtagaaacccagcacggtcagcaacagcggcagccacatctcggcgggcatcgccggtttttccgtgagggtgaaggtcgcgccctggtgcagggtgttccaccactccaccgaatatttgatgatcgggatgttgatcacaccgacgatcgccagcaccgcgcaggccttggcggcgctgtcacggttgctgatggcattgcccagggcgatcacgccgaaatacaggaacagcagaatcagcatcgaggtcaggcgcgcgtcccagacccaccacgagccccaggtcggcttgccccagatcgccccggtgaccagcgccacggcggtcatccacgcgccgatcggtgcggcgcattgcagggcgacgtcggccagtttcattttccacaccagccccaccacaccgcaaaccgccagcatcacgtagatcgactgagcgagcatcgcggcgggtacgtggatgtagatgatgcgaaagctgttgccttgctgataatccggcggcgcgaaggccaggccccaaacgacgccgacgccaatcagcagcaacgctgcgatgctcaaccacggcaggaacttgctgctgatgccgtagaaccacttgggcgagccgagcttgtgaaaccaggtccagttcatactgtttccatcacggatgctcttcgctatgaagagccagggtctttactgatcaaaaaatgatcagacctcattattcgccgacgctgatcttcaggccagcggctattgcaaagggtgtcagggtgatcgccagagcggtcaggctaccaagccacagcagatacccggtcgccggcatgccttggagggcggcctgcaaggcgccactgccgaggatcaacaccgggatgtacaacggcagaatcagcagcgccagcaacaggccgccacgtttcaaaccgaccgtcaatgccgcgcccaccgcgccgagcaagctcagcactggtgtgcccaacaacaacgaaagcagcaaaaccggcaggcaggcgacgggcaaaccgagcatcaacgccagcaagggtgagagcaaaaccagagccagaccggagaaaagccagtgtgccagcaccttggccaagaccagaagtggcagcgggtgcgacgaaaggacccactgttccagggagccgtcttcgaaatcactgcggaaaagcccgtccagcgagagcaggaccgacaaaagcgccgccacccagactaacccgggggacaggttttgcaacacttgagtttccgggccgacggccagcgggaacaaagcaatgacgatagcgaaaaaaatcagcggattggcgagttccgccgggcggcgaaacagcagtcgggattcacgggcaaccagcaggccaaacacactcatactgcccagttccccagatcgatgtcgcgataaccggccggcatccggctcagtgtgtggtgcgtggtcaagaccaccagaccgccgcgctcacagtgtccggccagatgttcttcgagttgcgccacgccctgcttgtcgagggcggtaaacggctcatcgagaatccacagcggcgggctgtccagatacaggcgcgccagcgccacgcggcgttgctgaccggcagaaagactgtggcagggaacatcttcgaaaccgcgcaatcctactgctgccaaggcttgccagatggcgtcgcgttcggcgggatgatgcagggcgcagagccaggagaggttctcttccggggtcagtagatccttgatcccggcggcgtggccgatccacagcaggttgcgtgcaagttcgctgcgctgttcggtcagcggccggccattgagcaggacctgaccgtcggtcggctgcatcaacccggccagcaaacgcaataaactggttttaccgctgccgttgggcccgctgatctgcaccatatcgccactggcgagtctcaattcgagattttcgaagagcagccgctgatcacgctcacacgcgagggcaacggtttgcaggacaggactggtcaagggatcacgggccttatacggttcaagtcggctctggcgcggccgttaaagaggtgcagcataaatgcattgacggctcgatccagagagctgggtcaaacaattgctatgttttttattcgaagcgcaagacgggcggcattatacatggcgtgccttactctcaagagtgcattttcctcaggttgtgtccgcgtatgacaggcgaaatgaacatcctcccgctcccgcccaccaccccggcgacggttcgcccgcaggtgggtgaactgctcaagctgctgacaccggtcgagggcttgatcggcgccgggcaaagcgccaaggctgaggtgttgtcgctcaaacaggcggatcagacctttcagttattgctcaaggtgactgtcgacggcggacgccagaccaccgtgcaagcgaccagcaacctgccgttgccgcaaggcaccagtctggcgatcactcagccctcggcgggcaacctggcgattaccgtgcagcaagcgattgccagcggcgtcgccgccctcacccgcatcgacaccgcgcaattgccggtcggcacgctgctgcaaggcaaagtgctgacctcgcaggcgctgccacagacgccggggcaagcagcagtgtttcgctcattggtcagtctgctcaacaccgcacacagcggcagcacgctgaccatcgacagcccgcagccgctgcgcattggcaccctgctgtcggcattggtcgaagatacacaaaccctgaaattcctgccgatgagcagtcgtcaggaacaactggccgtcagtcagcaactgctcggccagcaaagtcgtcaggcatccctgacagggttgctgaatgctttgcagaatctgccgagcgataccgatcagacatcgcaggatttacgcgcggtggtcgacaaactccttgccagcctcccggacgtgcaacaactgagcaccgccaaaggcgtcgcactggcgctggccaacagcggcgcgttcctcgaagccaaactgctgaccggacaaaccccgacgctggccccggacatgaaagccgatctgctcaagctgatcgcgcaactgaccccgggcctgccgagcagcaccagtttcaacgcgatcatcgccgccaacaccttggcgcaagcgctgccgagtttcgtccgcaacgccctcggcatgctcggccaggtcagcgccaaaccggtaccgagcagcttcccgctgcccgagcgtttgctgcaaagcctgggcggcgaaggtgatctggaacagttactacgcctcgccgccgcagcggtttcgcgcctgcaaagccatcagctgtcgagcctggaacagaccggcgtcaccgacgacggacgcctgctcagcacctggcaactggaaatccccatgcgcaacctgcaagacatcgtgccgctgcaggtcaagttccagcgtgaagaagcgccggagcgcgaaccgcaaccgaacgagcgtcgcgatgagcacgagccgaaacagcaactgtggcgtgtagacctcgcattcgacatggagccactcgggccgatgcagattcaggcgcagttgattgccggcagcctgtcgagccaactgtgggccgaacggccgtacaccgctgacctgatcgaaaacaacctgttcgccctgcgccagcgtctgcttgatcgcgggttgaacgtcggcgacatcgactgccatctcggcaccccgccgcaaggcaaccaaacccgtctcgaacatcgctgggtcgacgaaaccgcatgaacgattccactgccccacgccaggccatcgccctcaaatatgacggcaaccacgcgccgacgctcactgccaagggtgacgaagaactggccgaagaaattttgcgcattgctcgcgattgcgaagtgccgatctatgagaacgccgagttggtgcgcttgttggcgcggatggaactgggcgacagcattcccgaggagctgtaccggacgatcgccgagatcatcgcgtttgcgtggaatctgaagggcaaattccctgaggggcaggacccgaatgcgccgatggtcgagaaggacgtcaccgagcgtggggatgactattgatcgttcccacgctctgcgtgggaatgccgcccgtgacgctctgcgtcacatttcacaggcggaacgcggagcgtcccaagatgcattcccacgcagagcgtgggaatgatccctgtacgaccatcagttcttgtgaagcttgcgcatcaattccgcctcagcctgggtcaacccacacgactgagtcagctcatcaacgctcgcacccatgcccaccagtttcgccgcctgggcgaatgacaggctcgatggatcgcgctgttccagctgaacgattttgtccggcaacggactgactaccgcgcgcagttcgtgcagggcttcgcccatgcgcacgttgccgttctggtaatcgtcgacacgcttggccaggtccttgatgcgctgatcacgcagcgcatcgccctgagcctgttgcgcagcgattacccgctgcgccttgatgtacgacacaaacattgccagtgtgcctgcccagaataggaacaggacaatgaccgcaacttcgagaatcaatcagatattctccaggtccgaccattcttcttcgctcatcatcttgtccagctcgaccaggatcaacaactcgttgttcttgttgcacacgccctggatgaacttggccgactcttcgttaccgacgttcggcgcggtctcgatttccgactgacgcaggtaaaccacttcggccacgctgtcgaccatgatgccaacgacttgcttgtcggcttcgatgatgacgatacgggtgttgtcgctgatctcgccgctgttcaggccgaagcgctggcgggtgtcgatcacggtgaccacgttaccgcgcaggttgatgatgcccagcacatagcttggcgcgcccggcaccggagcgatctcggtgtagcgcagcacttcctgcacgcgcatcacgttgatgccgtaggtttcgttatccagtttgaaggtaacccattgcaggatcggatcttcagaaccttttgcattcgtcgcctgactactcataccctgacccctcgaaaaaaccgcgctgggcggtgtgtgttctgtgtggcggcattcaacaatgccgtcgcctgattgttatgtcggctgctatgtcggtttatgtagcggcttgtggccgccgaggtgctttgccccaccgctggcgatcaactcggccagtgcggaaacgtcaagcaatgcacacatgtgctcaatcacggtgccggcgagccatggccgctgaccccggtgacttctccatttgatttcattcgggtccagacgcaacgagcggctgacctgatgcaccgccagcccccactcgtaaccttgtaccgaaatcacgtactgcaagccctgacggaagtcatcgcgatagcgatccggcatgacccagcgcgcggtgtccaagactttcagattgccggcctggctcggcaggatcccgaggaaccattccggctgaccgaacagcggcgtcagctcgtggccggccagcgaatagatcgagccgaggcacaccagcggcaccgcgagggtcaggccggcgacgtcgaacagcaggcattcgaaggcttcagaggcccaagccgggcgaccatcggtttccaccggtggcggcgtgttgttcggcggcagatgcacttcgaccagcggcggcaccagcgtctgctcgacaggcgcgggcgcaaccggagctggagcgggctcgaccacggccggttccggcgcagttttcagcagttgggtttgcagcagcggcgccaaagtcgaaacggacgcgcgaaccggctcggcttcttcaatcaatgtaaccggtgccttggcgaccggtgcggcggcaggcgcaacaaccggcgcaacaggcttggcggctttctgcgcatcacgcgcctgctcttccagcaccgccgcctgaaattcgtccagcgtctcggtgcttgccacaacctcaggctgcgcctcaatgaccggcggcagctcctcaggaatgtcctgcagcaaattatccagataagactgcaacgccaattgcggcttcgacgtcaacttgagcggccgattcatacgcaaccccaggtaggagctgccgcaggctgcgatcttttgatcttttcaggaacgccacaaagcaagatcaaaagatcgcagcctgcggcagctcctacaaggttcaacgtcattcaagccacctgcggaacaagttgttgcgccaacaggtgcttgagcagcgcgcggtaggccagcacgccacggctcttgccgtcgaattgcgaaggcgtgacaccggcccggctggcgtcgcgcagacgagtatcgaccgggatgtaaccctgccagatctcctcggggaatttgtcccgcagcacgcgcaaggtatgcatcgatgcctgtgtacggcgatcgaacagggtcggcacgatgctgaacggcagcgcctgtttgcgcgagcggttgatcatcgccagggtgttgaccatgcgctccagacctttgacggccaggtgttcggtctgcaccgggatcaccagctgctggctcgccgcaagcgcattgaccatcagcacgccgagcaacggcgggctgtcgatcaccgcgtaatcgaagtcctgccacagttgcgccagactcttggcgatcaccagacccaagccactctgccccggcgactgacgctcaagggttgccagtgcggtgctcgatggcagcagggaaattcgctcgtcgctggtcgacaacagcaactgccccggcaggccttgcggcacgctgcccttgtgcagaaacaggtcgtagttgctgtgttccaggctgtcgggatcgtagccgaaatagctggtcatcgagccgtgggggtcgagatcgaccacaaccacgcgcttgcccgcctcggccagcaatccggctaaagcgatggaagatgtggttttaccgacaccacccttttgattggcgactgcccagactctcattcagttcgttcctcccggccgatatgctcgaccgagacatagctcagcgtgttaatgcgggtgacggagaattgacggcactctcgcgtcccggcgtcttgaccggggtcggtgcagtttgtgtgccagcacgcttcaacgcagcgtccggttgcgcattggcggttccggtgcccgtgaggctgcgacgtacatcgagattgcgcgagaccaccagaaccacccggcggtttttcccccggccttcagcggtagcgttgttggccaccggttgaaactcgccgtaacccaccgatgccaatcggccagggttcacaccctgcatcgccagcatgcgcacgatgctcgccgagcgcgccgaagacagctcccagttggtcgggtattgcgcggtgcggattggctgatcgtcggtgaagccttcaacgtggatcgggttatcaaacggtttcagaatcgccgccaccttgtcgatgatgttgaaggcgatgtcgctcggcatggcatcgccgctgccgaacaacaggctggagttgagttcgatctcgacccacagctcgttgccacgcacagtcatctggttggagctgatcaggtcaccgaaggcggcgctgatgtcatcggcgatgcttttcagcggatcgctggcgccggcgataccggcgtcgatctgctcggcgtccttgaccagtggcttggccggggtcacggttttcggtcgttcgtcgccgatctggatcggtttgagcgcgcgatcggagtctttgaagacgccgaccagcgcttcggaaatctctttgtacttgccttcgttgatcgacgaaatcgagtacatgactacgaagaacgcgaacagcaacgtgatgaaatccgcgtaggacaccagccagcgctcgtgattgacgtgttcttcctgatgcctgcgacgagccatgaggttattcccttaatccatgaagccttgcagcttcaactcaatggagcgagggttttcaccttcggcgatcgacaaaatgccttccaacaacatttcgcgataacgcgactgccgcaacgcgattgacttcaatttggctgccaccggcagcaggatcaggttggcactggccacgccatagatggtcgcgacaaaagccacagcaatgccgctgcccaactgggtcggatcagcaagattgcccatcacgtggatcaggcccatcaccgcaccgatgatgccgatggtcggcgcgtaaccgcccatgctttcgaagactttcgccgcttcaatgtcgcgcgcttcctgggtgtagaaatccacttcaaggatgctgcggatcgcttccggctcagcgccgtcgaccagcagttgcaggcctttgcgcgagtagttgtcaggttcggcatccgccacgccttccagaccgagtaggccttccttgcgcgcagtgaggctccagttgaccacgcgatcaatgccgccggccaagtccacacgcggcgggaagaagatccacgccagaatctgcatggcgcgtttgaacgcgctcatcggcgattgcagcagtgcggcaccgatggtgccgcccagtacgatcaatgccgccgggccgttggccagcgcaccgaggtgaccaccttccaggtagttgccgccgatgatggcgacgaacgccatgatgatcccgataaggcttagaacatccatcagatacacgcctcgacaatgtgtttgccgatgtcgtcgaggctgtacaccgcgtcggcgaggtcagctttgacgatagccatcggcatgccgtagatcacgcaactggcctcatcctgcgcccagatcgagctgccaccctgcttgagcaggcgcgcgccttcacggccatcggcgcccatgccggtcaacaccaccgccagaactttgtcgccgtaggacttggctgcggaaccgaaggtgatgtccacgcacggcttgtaattcaaacgctcgtcacccggcagaatcttcaccgcgccacggccgtcgatcatcatttgcttgccacccggtgccaacagcgccaggcccggacgcaggatgtcgccatcctcggcttccttgacgctgatgcggcagagcttgtcgagacgttcggcaaaagccttggtgaacgccgccggcatgtgctggatcagcacgatcggcgccgggaagttcgctggcaactgcgtcaacacgcgttgcagcgcaaccgggccgcccgtcgacgtaccaatggcaaccagtttgtaggctttgcgtttcggcgcgggcgacgaagcgctggcggccggggcgcgagtcggtgccggcgctggagccggacgtgccggcgcgctggtgctgtgactgctaccgtggctgccgaaactcgacggcgccggagcaggcgtcggtgctggcgcagccactggagccggcgcgctgtaagcactgaaacgacgattactgcgcgagatgctatggaccttctcgcacagcagttgcttgaccttctcgggattgcgcgagatgtcttcgaaattctttggcaggaaatccaccgcgccggcgtccagcgcatcgagggtgacccgggcgccttcgtgcgtcagcgaggagaacatcaacaccggggtcgggcagcgctgcatgatgtgccgcaccgccgtgatgccgtccatcatcggcatctcgtagtccatggtgatcacgtccggcttgagtgccagcgcctgatcgatcgcctctttaccgttggttgcggtgccgaccacctgaatgctcggatccgcagaaagaatttccgagacgcggcggcggaaaaaacccgaatcgtccaccaccaggactttgactgccataaacactccattaggtgcagcgggacgtcatcgccccgccgccccggattcaaatacgccgtgcggcgtaacgcttgagcatgcttggaacatcgagaatcagcgcgatgcggccgtcaccggtaatggtggcgccggacatgcccggagtgccctgcagcattttgcccaatggcttgatgaccacttcttcctggccgaccagttgatcgacgacgaagccgatccgctgcgtgcccaccgaaaggatcaccacgtggccttcacgctgctcttcgtgagcggcggagctgaccagccagcgcttgaggtagaacaatggcagcgccttgtcccgtacgatcaccacttcctgaccgtcgacgacgttggtggtcgacaggtcgaggtggaagatttcgttgacgttgaccaacgggaacgcaaacgcctgattgccgagcatgaccatcagggttggcatgatcgcgagggtcagcggcaccttgatgacgatcttcgagccctggcccttggtcgagtagatgttgatcgaaccgttgagttgggaaatcttggtcttcaccacgtccatgccgacaccacggccggacacatcggagatctcggtcttggtcgagaaacccggggcgaaaatcaggttgtagcactcggtatcgctcaagcgatcggccgcgtccttgtccatcacaccgcgttttaccgcgatggcgcgcaggacgttcgggtccatgcctttgccgtcatcggaaatcgacagcaggatgtggtcgccttcctgctcggccgccagcaccacgcgaccgccacgggccttgcccgacgcttcgcgttcttccggcgactcgatgccgtggtcgacagcgttgcgcaccaagtggaccagcgggtcggccagggcctcgacaaggtttttgtcgaggtcggtttcttcacccaccagttccaggttgatctctttcttcagctgacgcgccagatctcgaaccagacgcgggaagcgcccgaagaccttcttgatcggctgcatccgcgtcttcatgacggcggtctgcaagtcagccgtgaccacgtcgaggttcgacacggccttttgcatggcttcatcgccgctgttcaggcccaggcgcaccagacggttacgcaccagtaccagttcgccgaccatgttcatgatttcgtcgagacgtgccgtgtcgacgcgcacggtggtttcggcttcgctcgccggtttttccgctggcggtgtcgccggcgcacgggccggagccggtgcagcagcggcagccggttttggcgcttcggctttcggttcaggcttggcaacaggcttgggcgctggcgctgcggccggcgccttggcagcaggcgtggcgacggtcgaagcactgccagcagcggcggtgccgacttcggtgaacttgcctttgccgtgcaattcgtcgagcagcgattcgaactcgtgatcgctgatcagatcgctgccggccgccgcagcagccggtgcggctggcgcaggtgccgaggcaatcgccgactccagcgcatccacggcaaagttgcccttgccgtgcaactgatcgagcaaggcttcgaattcatcgtcggtgatgtcggagctgtcgcccttggccggtgccgcaggggctgctgcaactggcgcaaccgcgtccacggcgaactggcccttgccgtgcaactgatcgagcaacgactcgaactcggcatcggtgatttcatcgctcgcggcttcattggccgtttgcgcaggtgcagcagcggccggggcttcggcttcggccttgacggcgttcagcgaatccagcagctgttcgaattcgttatcggtgatgtcgcccgacgcgtcgccttcgacgaccagttcttcgatcatctcggccaccggcgaagccggagcagcgtctgccgattgcggttcggccaggcgcgccagggcggccagcagttccggggtggcagcagtgatcggcgcacgctcgcggacttcgctgaacatgctgttcaccgcgtccagtgcttcgaggacaacgtccatcagttctgcatcaacgcgacgctcacccttacgcaggatgtcgaacacgttttcggcgatgtgacagcactccaccagctcattgagctgaaggaagccggcgcccccttttacagtgtggaaaccgcgaaaaattgcgttgagcagatctgcgtcatccggacggctttccagctcgaccagttgttcggacagttgctcaagaatctcgccggcctcaaccaggaaatcctgaaggatctcttcatcggcgccgaagctcattaatggggtgctcctacaggtctaaaaacccaaaaaacccaaattccaaaactctagaatccaaggctggataacaaatcgtccacatcgtcctgaccggacacaacgtcttctcgtttatcggcatgaatctgcggaccttcaccctgcgagagatgtttttgtggatctttttctgcaagcatcgcggcacggtcatgttcaatgcccgcaaagcggtcaacctgactggccatgaggacaagtttgagcaaattgctttcgacttcggtgaccaattgggtcacacgcttgatcacctgaccggtcaggtcctggtaatcctgggccagcaggatgtcgttgagattgctcgacaccgcacggttgtccgtgctgctgcgtgacagaaaaccgtcgacccggcgcgccagttcgcggaactcttcagctccgacttcacgacgcatgaagcgaccccaatcggcactcaaggtctgggcttcatcagccagactgttgaccaccggcgtggcgctttccaccagatccatggtgcggttggccgcggcttctgtcagtttgaccacatagcccaggcgttcggtggcgtcggtgatttgcgacacttcctcggcctgcggcatgttcggatcgatctggaagttgacgatcgcactgtgcagttcacgtgtgagcttgcccacttcctggtacaggccacggtcacgggtctgattgagctcatggatcagttgcacagcgtcgccgaacctgcctttttcaaggctctcgaccagttcgaccgcgtgttttttcagggtcgactcgaaatcgccctgtgaagattcgttatgctccatagctcccccgcgcgttcatcagccgatgcgttcgaaaatcttctcgattttgtctttcaacgcctgagccgtgaaaggtttgactacgtagccgttcacaccggcctgagcggcttcgatgatctgctcgcgcttggcttcagccgtcaccatcagtaccggcaggtgcttgagcttttcgtcggcacgcacgtgacgcagcaggtcgataccggtcatgcccggcatgttccagtccgttaccagaaagtcgatgcttccgctgttgagcaccgggatggcggtagtgccatcgtcggcctcgacggtgttggtgaacccaagatcacgcagcaggttcttgatgatccgccgcatcgttgagaagtcatcaacgatgaggattttcatgtctttgttcaattcgacctccaagcagtcttaaacgcgcccagcacctggacgcgccacttcaatcaatcggcgcagcactcaaagactgtctggagcacaacagagcaagaccggtgccgttcatcaccgcaccagcctcgttcgcagtgtccccacactgccttcagcgcgctcgccactcccccaaacgcccccgcaaacgggccgcgcactggctgtgtaactggctgacccgcgattcactgacgccaaggacttcaccgatttccttgaggttcagctcttcgtcgtagtacagcgccaacaccagtcgctcacgctccggcaaattggcaatcgcgtccgccagcgctgcctggaagcgttcatcctccagatcgcgcgacggctcaagatgagcactggcgccatcctcgtgcagcccttcgtgttcgccgtcctgcaacaggtcgtcgaaactgaacaggcggctgcccaaggtgtcattcaaaatcccgtagtaatcgtcgagactcaattggagttcggctgcaacctcgtgatctttagcgtcacggccggttttagcttcaattgagcgaattgcgtcactgaccatacgggtattgcggtgaaccgagcgtggcgcccagtcccctttgcgcacttcgtcgagcatcgcgccgcggattcgaatgcccgcgtacgtttcgaaactggcgcctttgctggcgtcatacttggtcgagacttcgagcaggccgatcatcccggcctggatcaggtcttcgacctgcacactcgccggcaaccgcgccagcaagtgataggcaatgcgtttgaccagtggcgcgtaacgctcgatcagctcgtactgagcgtcgcgtgccgacttcttgtagtaattcataccgctagcggtcataacacgggccctgccgtttgctgcacgagacgctcgacgaaaaattcaaggtggccgcgcgggttggcgggcagcggccaggtgtcgaccttctgtgcaatggccttgaacgccagcgcgcacttggagcgcgggaaggcttcgtagactgcacgctgcttctgcaccgctttgcgtacgctttcgtcgtaaggcacggcgccgacgtattgtagagcgacgtcaaggaaacgatccgtgaccttggtcaacttggcgaacaggttgcgcccttcctgcgggctctgcgccatgttggcgaggacgcggaagcggttcatgccgtagtcgcggttgagcaacttgatcagcgcgtaggcgtccgtgatcgaagtcggctcgtcgcagaccaccagcaacacttcctgcgctgcgcgcacgaaactgactaccgagtcaccaatacccgcagcggtgtcgatcaccagtacgtcgagattgtcgccgatgtcgctgaacgcctgaatcagaccggcatgttgcgccgggctcaggtggaccatgctctgcgtgccggacgcggccgggacgatgcgaatgccgccggggccttgcaacaggacgtcgcgtagctcgcagcggccttcgatgacgtcagccagcgtgcgtttaggggtcagacccaacaaaacgtcgacgttcgccagtcccagatcggcgtccagcagcatgacccgacggccaagctctgccagcgccagagacaagttcactgacacgttagtcttgccgacgccacctttgccgccggtcaccgcgatcacctgtacgggatgcatgctgcccatgttatttctttaccttgtcttgcatagacggaggccacattactggctgcgcgttcacaaccggaacaatgcatggcagaccatcgatgtaggtacaaaaactgttcatgaatacctcagcctacctgcttggtcgggctgtgatagatatcagcgaacatgtcagccatggcttcttcgctgggttcttcctgcatttgcacgctgacggcgcggctgaccagttgatgacggcgcggcagatgcaaatcatccggaatccgtgggccatcggtcaggtacgcgaccggcaattcatgactgatcgccaggctcaacacttcgcccaggcttgccgtttcatccagtttagtcaggatgcagccagctagcccacaacgcttgtaactgtgataagcggccgttagaacctgtttctggctggtggttgccaagaccagataattttttgagcgaatgccacgaccggcgaggctttcgagttgcatgcgcaaggccggatcgctggcttgcaggccggcagtatcgatcaataccacgcgcttgcgcagcagtggatccagtgcctgcaccagcgactggcccggatcgacgtgagtcaccggcacattgagaatacggcccagcgtcttcagttgttcctgcgcgccaatacggaagctgtccatgctcaccagcgcgacattctgcgcgccgtacttgagcacataacgcgcagccagtttggccagcgtggtggtcttgcccatgccggcagggccgaccatcgcaatcacaccgccctcttccagcggctcgacttccggtacggcaatcatccgcgccaggtgcgcaagcaacatgcgccaggcctgacgcggctcttcgatatcggtgatcatcgccagcagatcgcgcgacaacggcccggacagcccgatacgttgcagacggcgatacaggttggcttgcgccggacggctgccttgcagctgattccaggccagggtgccgagctgcacttccatcagctcgcgcaggctgttcaattcaaagcgcatcgaatccagtgcgcgcggatccacgccgccggaggactgcgcaggcgccggcgccgggcgcgccggagcggcgtaggtcggctcgctcagcggttcggcagcggtcagtggcaggccagccgtcaacggcagcccggcaaagatctggcgattgctattgccgtcggcttcgccacgcaggctcaactcggcctgggcggtgacgatgcgcgactgagtcttgcgcagctcgtcttcgagttccatgttcggaacccgtggcgccagcgccgacagtttgtaatccagtgccgccgtcagctcgacaccgccggcaatgcggcgattgccaatgatggcggcatcagcgcccagctcatcacgaaccagcttcatggcctgacgcatatcggcggcaaagaaacgcttaacttgcataaaccactacctcagccgttgggccctactgtcgcaacgatggtcacttgcttgttgtccggtatttcctggtaggccagcacatgcaatccagggactgcgaggcggccgaagcgcgaaagcatcgcgcgaaccggacctgctaccaacaggataaccggctgaccttgcatttcctgacgctgcgccgcttcgatgagcgaacgctgcagcttctcggccatgcttggctccagcagaacgccctcttccgagccttgtcctgccttctgcagactattgagcaatatttgttccaaccttggctccaaggtgatcacaggcagctccgactcagtgcctacaatgctttggacgatggcgcgcgatacgccgacccgcaccgcagccaccaacgcggcagtatcttgactcttggcggcgttgttggcgatggcttcggcgatgctgcggatgtcgcgcaccggcacgtgttcagcgagcaacgcttgcagcactttgagcaactgcgacaacgtgaccacgcccggcaccagctcttctgccagtttcggcgagcttttggccagcaattgcatgagttgctgcacttcctcgtggccgatcagctcactggagtgcttgtacagaatctggttcaagtgcgtggcaaccacggtgctggcgtcaaccaccgtgtaaccgagggattgtgcctgggcgcgctggctgatttcgatccacaccgcttccagaccgaaagccggatctttggcgttgataccgttgagcgtgccgtagacctggcccgggttgatcgccagttcgcgatccgggtagatctcggcttcggcgaggatcacccccatcagggtcaggcgataggcgcttggcgccagatcgaggttgtcgcggatgtgcacggtcggcatcagaaagcccagatcctgcgagagcttcttgcgcacgcccttgatccgcgccagcaattgcccgccctggttgcgatccaccagcgggatcaggcgataaccgacctccagcccgatcatgtcgatcggcgtcacgtcatcccagcccagctccttggtttccatggcgcgggccggcgacggcagcagttcctgctgacgcttgacctcttccagcgcgaccactttggcgacgttctgcttcttccagaacaggtaggcgccaccggcggccagcgcggccatgctcaggaacgagaagtgcggcatgcccggcaccaggcccatcaccgccatcaaaccggcggccacggccagcgctttcggcgaggcgaacatctggcggttgatctgtttgcccatgtcttccgagccggaagcacgggtcaccatgatcgctgcagctgtagataacaacagtgatggcaattgcgccactaaaccgtcaccgatggtcagcaaagcgtaaaccttgccggcatcaccgaagctcatgttgtgctgaaagataccgacggccataccgccgatgaggttgatgaacagaatcagcaggccggcgatggcgtcaccacggacgaacttgctggcaccgtccatcgaaccgtagaactcggcctcttgggcaacttcctgacggcgcatcttcgcctgattctgatcgatcagaccggcgttgaggtcggcgtcgatcgccatttgtttgccgggcattgcatcgagggtgaaacgcgcgctcacctcggaaatccgcccggcacccttggtgaccacgacaaagttgatgatcatcaggatcgcaaacaccacgataccgaccacgtagttaccgccgatcaccacctcaccgaaggcctggatcaccttaccggcagcggcgtggccgtcctgaccgtggagcatcacaacgcgcgtcgacgctacgttcaacgccagccgcagcaaggtcgcgaccagcagaatggtcggaaacacggcgaaatccagcggccgcagtgcgtacacgcagaccaacaggacgacgatcgacagggcaatgttgaaggtgaagaacacgtcgagcaggaacggcggaatcggcaacatcatcattgccaacataaccagcagcaacaacggcacgcccagattgcctcgactgaggtcggcaacattcgtgcgagcagtgttgaataactgagagcgatccaccggttttccccgttcctttaaagcaaacttttgacgcccagagcgggctcacggcgggtactgcaagaagctttccaacttttgccggggagtgaaatcgggagagaaaacatgactcatgcaggagtgagcctgctcgcgatagcggtctgtctggttcgaatccatcgactgaaaaagccccatcgcgagcaggctcactcctacagcgggaccgcattccaaatgtgggagcgagcttgctcgcgaaggggccagtgcagtcagcgcaatgcgcctcttaaactctggcgtttaaaagacacctccagacacgcctttgaggctacaaatccttgcgcctttgcctacagccaagccagaatccgccggcttgtgcgctttggggtcgggttctattgtgggtcggtcgctgacgaatcagcgaccgggtttagcgactcgaactcaagtcaaaggtgcatcggcgttccaggcttcgttgcggatctgtattttcgcgatttcgtcatggtggctgtatgcgggagaccttcgggtctgccgggtgcctttgaccggttcgctaacctgcgtacagccgccacccctcctgtttagcgacaggttgtagcggctccacctcaaaggagcttcaccatgatcaaaccaacacccaacccgcccgaaaccgaccccacccccccccccctacgaatccctcgactcaaaaaaactccacgaagccgccgaccgcgccctcgaccactacctctgcccacccggcgccacgccgccgccacgcaaaacccgctcgatgtatgccgtaaccgcagacttcaaaaacgaggagctgctggccgacgcctgcgaaaccctcgcttgcgccagaaccatcgccaacgacttcgccaatctcataccagcatcgcagcgcagaacgctgctgggcatcgcgcaattgatcatgctcggggaactggcggtgaatcgggcgctggataatctgcagttgccgaattagttcggtcacagatcgttcccacgctctgcgtgggaatgcctcaacggacgctccgcgttcggctctgggaaagggacgcggagcgccccgggctgcattcccacacagagcgtgggaacgatcagagacaaaaggtatgaggggagaaatcaggaatcgcggcgcaggtccggtggaatcggcaaatcgtccttgagcggatccgggcgtttgcccttgcccgcacggtactggcggatctggtagacgtaggccagcacctgggcaaccgccaggtagaggccaccaggaatttcctgatccagctcggtggagtagtaaatcgaccgcgccagccccggcgattcaaggagcatgacgttgttggccacggcgatttcgcggattttcagggcgaggaagtcgctgcccttggccaacagtatgggcgcgccgcccttttcggaatcgtacttgagcgcgacagcgtagtgcgtcgggttggtgatgaccacgtcggcgtcgggaatcgccgccatcatccggcgctgggacatttcgcgctgggtctggcggatgcgctgtttaacctccgggcgaccctcctgatccttgtgctcgtcgcgcacttcctgcttggtcatcagcagtttcttgtgcgcctcccagagctgcaccggcacgtcgacggcggcgatgatgatcaggccgcaggcgagccacaaagtgctccagccaaccaacgtaacgctgtgaatgatcgccatctccagcggctcatgggcgatccgcatcaggtcatcgacgtccgacatcagcaccaccagtgccacacccaaagtgaccagaaacttggccagcgccttgagcagttcgaccacagccttgaacgaaaacatccgcttcaggccggccgccgggttcatccggctgaacttgggtgccatggagccggccgcaaacaaccagccacccagagaaatcggcccgatcaatgccgccagcaataacgtgatcatgaacggctggatggccaacaacgccatctgacccgacttcaacaaaaatgcgcccatggaaccctgatccatgatcacctcacgcgacagcgtgaagttcatgcgcatcagttccatcaggtcttcggccagcataccgccgaacaccagcagggcgccggcaccagccatcatcacggcaagggtgttgagttctttggagcgggcgatctcacccttttccctggagtcctttttacgtttctccgtggggtcttctgttttgtcctgaccgctttcgctctcagccatgactcagcgcgcccgtgccagttcgcgtaacaactgcaaggcctcggtggccagcggctgatactgattgagaatgtccgccagccccacccagacgatgaacagcccgagcaccagggtcagtgggaaaccgatggagaaaatgttcaattgcggcgctgcacgggtcatcacgccaaatgcgatgttgaccaccagcaacgcggtgacagccggcaacaccagcaacaacgctgcgcccagcacccacccgagcttgccggccaattcccagtactgcgccgtcattaatccgccaccgaccggcagcgtggtgaaactttcggtgaggacttcgaagaccaccagatggccgttcatcgacaggaacaacagggtcacgagcatggtgaagaactgcccgatcaccgccaccgagacgccgttggccgggtcgaccatcgaggcgaagcccatgcccatctggatcgcgacaatctgcccggccacggcgaacgcctggaagaacagctgcagggaaaaccccagcacggcacccaccagaatctgttcggcaatcagcagcaaaccgctcagatccagagggctgaccgccggcatgggcggcaggcccggggcaatgcacacggtaatcgccacggcgaaatacaggcgtatccgccgcgacaccagcgtggtgccgaacaccggcatcaccatcagcatcgacgcgacgcgaaacagcggcaacatgaacgaggccacccaggtactgatctgggtgtcggtcagctgaagcagcgattgcatggcttagccgatgaccatcggaatgtttttgtacaactggatgatgtattccatgaacgtctgcacgatccacggaccggcgacgatcagcgtcaccagcatcaccagcagacgcggcaggaagctcagagtctgttcgttgatctgcgtggcagcctggaacatcgccaccagcaggccgaccaacaggctcggcaccaccaggatcgcgaccatcaacgtggtcagccacagcgcttcacgaaagatatcgaccgcgacttccggcgtcatggcgagacacccccgaaactgctggccagggtgccgatgatcagcgcccaaccatcaaccagcacgaacagcatgatcttgaacggcagcgagatgatcagcggcgacagcatcatcatacccatcgccatcagcacactggccacaacgaggtcgatgatcaggaacggaatgaagatcatgaagccgatctggaacgcggttttaagctcagacgtgacaaaggccggtacgagaatggtcaacggtgcctgatccggcgtggcgatgtcggtgcgcttggacaggcgcatgaacagctcaaggtcgctggtgcgggtctgcgcgagcatgaagtccttgatcggcacctgagccttttccaccgcttgctgagcggtgagtttttccgccaggtacggttgcagcgcatcgttgttcacccggtcgaataccggcgccatgatgaacagcgtcaggaacagcgccatgccggtaaggatctggttcgacggcgtctgttgcagaccgagggcctgacgcaggatcgagaagacgatgatgatccgggtgaaactggtcatcaggatgaccgccgccgggataaagctcagcgcggtcatgatcagcaggatctgcagactgaccgaatactcctgcgcgccatcggcgttggtgcccagcgtgatcgccgggatcgacaacggatcggcggcgaacgccagtggcgcggccagcaacagggccagcgtcaagacgatgcgtaacgcacccattacttcgtatccttctgatccttgccgagaatcttcagcaactgctgggcaaattccggggtcgctttttcactggtcgcaggcacgtcgaccggttccttgagcacatgcagcgcggtgatggtgccggggctgagcccgagcaggatctgctcgttgccgacctggaccagcagcaagcggtcacgcggactcagtgcgcgcgatccgatcagctcgatcacttgccccttcccggcaggacccgcctgctgcacgcgacgcaacagccaggcgaggaaaaaaatcacccccagcaccagcagcaggccgaacaccagttgcgtcaattgcccggccacgccgctggtcaccatcggcgcggtagcggcaggcactgtcgtggctgtcgacggctcagcagccagcacgctcagcggcaaggccaacagagcccagagaaaccttttcactcagcgcagcttcttgatgcgttcgcttgggctgatcacgtcagtcaggcggatgccgaacttctcgttgaccacaaccacttcgccgtgcgcgatcagcgtgccattgaccagcacgtccagtggctcaccagccagacgatcgagctcgatcaccgaaccctggttgagttgcagcaggttgcggatgttgatgtcagtgctgcccacttccatcgagatcgataccgggatgtcgaggatgacgtccaggttcggaccatccagcgtcactggatcgttatttttcggcacgctgccgaactcttccatcggcagacgcgagccgctggccgcgtcggccgccagcagtgcgtcgatgtcagcttgaccatcaccggtttcttccagggccgcagcccattcgtcagccagtgcctggtcgtcctgggcgttcatatcgtcgttcatcatgtgtcctcggcgggcaacaattcagttaatgcaaaaaagggggtgtggcgccgcttcagcgacgctcgatcggctcgatcacttgcaacgcgaggttgcctttgtgcgagcccatcttgaccttgaaggccggcacgccgttggcgcgcatgatcatttcgtccggcatctcgaccgggatcacatcccccggttgcatgtgcaggatgtcgcgcaacttcaactggcggcgagcgacggtggcgccgatcggcacgtcgacatcgagcacgtcctgacgcagggcgttgacccagcgctcgtcctgatcgtcgaggtcggactggaaaccggcatcgagcatttcacgcaccggctcgatcatcgagtacggcatggtcacgtgcaggtcgccgccaccgccatcgagttcgatgtggaaggtcgacaccacaatcgcttcgctcgggccgacgatgttggccatggccgggttcacttccgagttgatgtactcgaaattgacttccatgattgcctgccaggcttctttcaaatcgacgaaagcctgttccagcaccatgcgcaccacgcgcagttcggtcggggtgaattcacgcccttcgatcttggcgtgacggccgtcgccaccgaagaagttgtccaccagtttgaacaccagtttggcgtcaaggatgaacagcgcggtgccgcgcaacggcttgatcttgaccagattgaggctggtcggtacgtacagcgagtgcacgtattcgccgaacttcatcacctgtacgccaccgacggcaacgtccgccgagcggcgcagcatgttgaacatgctgatgcgggtgtaacgggcaaaacgctcgttgatcatttccagagtcggcatgcgtccacggacgatgcgatcctggctggtcaggtcgtagcttttgacactgccgggttcggcagcgttatcggtctgtaccagaccatcgtcgacgccatgcaacagcgcgtcgatttcatcctgggacagcagatcctgcacggccatgtcgtgttcctactgcagtacgaaattagtgaaaagcaactgttcgatcaccactttgcccagctctttctgcgccacttcctggacgctggctgtggccttctggcgcaacatctcctggccgaccggggtcgccaaggtggcaaaatcctgaccggagaagagcatcaccaggttgttgcggatcaccggcatgtgcactttgagcgcgtccagatcggcctggttacgcgccagcatggtgaggctcacctgcatgtagcgctgacgaccgttctggttgtagttggcgacaaacgccggcgccatcggctcgaaaatcgccggttgcttgccgacgggcgccgcatcggcggcctcggcaggcttgctctgggcactgtgcatgaagaaccaggtcgcccccacggatgcaccaatggccaatagcaatgccagcacgatcacaatgatcagcttgagtttgcctttggttgcggggtctttcactgctgctgtttcgctcttcgccatgccaataatccgtcactaatcgggttttcacagtcgcacggcaaggcaagagcaagtgttatgccagaagtgtcagtgatggtggagacaacgctaaagtcaaaggcaccctcaccccagccctctcccggagggagagggggccgaccgaggtgtcagacgtcaaacatcgacctcaaagactgagtcgattatggatttacagcagaagtagtgagacatcgacctgaaagaccgagtcgattgtggattcacagcagaagtaaccggtcggcgcacgtcccgagcaccccccgatcagtcccctctccctctgggagagggctagggtgaggggctcttgatttgatcaggcgtaatagtcgaccgcgctggagccaatcacgctggtagtttgagcagcggcttcagcaatggcggcaggcgccaattcttcatccgccgaatcgaggcgaccgccggccgcgctggtgcggccactctggccctgctgcgcctgctcctggccttgctggccctgccagccacggctctggtcggagacattgacgtcaacctggcccatgccctgctggttgaacatgtcacgcaggcgatgcatctggccgtcaagtgcttcgcgcacacttggatgcgcgctcatgaaggtcacctgtgtctgctgatccggcaccatgttcacgcggatatccagacgcccgagttcggccggctgcaattgaatgtccgccgccttcagattggcgctcgacagatacatgacgcggttgacaatttcttcagtccagccgctctgatgcatggcaattggttgattcaccggtaccgcgttggcggtcttcggtgtcgcggcctgagtcagtgccgccagacggttggcgaagtcatcgacacgggtatcgctggtcgcagtcttgaggtctttgagaccgtcatcgatcaaaccactgaaagccttgtcaccgccctgactggtgctgtccttgtcggcttgcacgtcgagcataccggccatgccggccgcaaaattctgcgccgccgtcagctcaccgtcggcctgagcctgagccggcgaggctttcggttgcgcctggctggcagcggaaatgtgcccgccctgctccatcgccatacgcaccactggcagcgagtcgagggggtccgccgaaggatcgaaatcactgtcagtggcaggcgccgggtctttgaccacgctcggcaatgcggcgagcgcagggggggcggtttcaggctgggcggtggcaaccggggtcggcaccacgggcggcgtggtcaccggctgcacagcgattgccaatgccggatcgagtgtcgggtcaacgggcgcgacatcaaccactgccggctgagaagtgtccgtgctgtcgtcgctgctggcggtggtgtcatcgctcgcggcggttttatcggctggcaagtcgttgccgctatcggcaaccgccggttgcgcagcggcagatgaatccttgccaacgtcctttttgccgctgttgtcagcaaccttgtcgcgcggcgacttgggcgaattgtcagcggctgcaacaggcttgctcgatccctgatcggcgaacactttcgcgaagcttgaggctttatccccggtgtctacggccatcgccgacgttttggcagaggcggcttgcgccttggcctgagcggcgttttgaagaaggatgttgggggtcgcaggcatgaaacggtctccgctgcactgggatcgtaggtacagttgcggagataactgcaagtgccgggccagttttgtccggcgcttgataaaagcgccggacggcgggatcagtgggtgtgagcgggatgtttttcgctttcgtaaaccgggcgaacttcagcaaattcgccactgatctcagcgaccagtttgactatttccgccggactcttgtctttggcgtccgattcgagttcctggcagagtgccgccaaacggacagcgcccatgttgctggcgctgcccttgaaactatgggcaacttccgacaacaccttggcatcagaggtcttttgcaactcgcccaagcgactttcggaatccgccagaaaggtatccagaagctccggataaccctcttccatgacttcgcgcagtacgctgagcgcctcgcgatcaatatgtgtgtcagccacttgttcactccttgatcaagaattgcgcggattatgcctgaacctcccaggaaaactccacgcgggcactacgaccttcgtccgaccaactggcgttgcgccccaattgccggaccaggctgacaccacgtcccgacaaacggacaccgtccagcggtcgatccatcacccgcgccacatcgaagcccttaccactgtcgtccacccgaatcaccagacgaccgccgtcgccctgcgactgcacctgcaaatgcacgcgcacgaaaccgtcctgcaacgcctccagccgatcgttgcgctgctgatagtagcgagcgaaacccgccgcatcgcgcttgagactggagtccagcccgagcacgccatgctcgagcgcattggaatacaactccgccagcacgctatacaaagcaccactctgcgcccgcaatccatgcacctcaagcagcaactgcagcaggtacggcaacggattgaaacgtttgagcgtggcgccgcaaaactcgaagcttaccgaccagtccagcgggcacgactggccgctgtcggaatacaccggtgccgagggcttgacctgcgccggctccagcaggctgacctcgaccatgctgacgtcatcgcgcgcctcgccgcgaaaatcccgcagtgcctgctcgatgtcctcgaacaagcgatccggctcgcggttggcggcgaacacctgctgcaagcgctcgacgccgaacaattgatcactggcatcgctggtgtcgatcaccccgtcggacaacaggaaaacccggtcaccgactgccatcggatgaacttcagtgcaatcgtcgaacgcttgggggctgagcactcccaacggcagatgccgcgcggccaacggcacgcgctcgcccgtggcgatccggtgcagatagccgtcgggcatgccgccattccacacttcgaccgagcgccgttgagaactcaggcacagcagcgtcgcgcagcagaacatgtccaccggcaggatgcgcttgagcttggcgttcatctcgcgcagggtttcggcaaggccgtagcccttggcggtcatgccgtagaacacttcggccaacggcatcgcaccgaccgcagccggcagcccatggccggtgaagtcgccgagcagcacatgcatgtcgccggccggggtgtacgccgccagcaacaagtcaccgttgaacagcgcgtaaggcgattgcagataacggatgttcggtgcactgaggcagccggagtgcgcaaccttgtcgaacaccgctttggccacgcgctgttcgttgagcaggtaatcgtggtgtttggcaatcagatcgcgctgctgcagcacggtcgcctgtaaccggcgcaagcggtccatcgccttgattttggcggcaaggatcacttggttgtagggcttcgccagaaagtcgtcgccgccggcatccagacaacgcaccagcgcttcgctttcagtgagcgaggtgaggaagatgatcggcaccagcgtctcgcccgccagcgccttgatctgccgcgcggcctcgaagccgtccatcaccggcatcatcgcgtccatcagcaccagatcgggtcgctgttggcgaaacagatcgagcgcttcggcaccgttggccgccgtcaggacttcgtggccctggcgacgaacgatggtcgacagcaataagcgatcggcggcgctgtcttcggcgatcaggatcgtcagcggctcttgcacctgcatggccgtcaactgatgtcgaagagtttgtcgaaattggagatggcgaggatctttttcacgtcggagctgctgttgacgactcgcacgtccgagttatcgccgccggcgtgatcgcgcagcaggagcaacatgcccagtgccgagctgtcgaggtaggtggcttctttcagatcgaccacaatggattctggtttcctgtcgagccgctcataagactcgcgaaattcctgatggcgcccgaaatcgaaccgccccttgaccgaaatcgtgagtttttgaccatccggagatacttctgcaacgactgacattgactggcttccttgtcattgacgaacgtgtacaaggtttagcatctggacagggttggggcaaggtcaggaagccagatcaaaagatcgcagccttcggcagctcctacaccgatcccctgccgaaggctgcgatcttttgatttttgtttcagaacggattctgtcggggcaatcgctgcgacagttcatcaagcagcttctgctcgcgcttgtcttcgaggcgttgcgcctcttcacggtagcgctgcaccagtttgcgcaggccttcgactttggcgaatgcctgttgccaggcctcacgcgcgttgtccagattcttctggtgccagttcaggctctgccgttgctgatcgacggcggtgtcgagctgcgccagaaagccctgaaaacccagcaaccattggccggtcacgccggtggcgccgcgcacgatccattgctcggagtagtccagacgaaaggcattgaggtcggccagcttgctttctgcgaccttcacttgcccctgaaagtaacccagccgctgcacagcggttttctcggctttttcagccatgtccaccaccggcgccagacgcgcggctcgactgacggcggccatgagcggttaaccgcccgccgcaggtgcgaacagcgtttcgagataggcctgactttcgcccatgttgattttgtcgttgaggccctgacgctgatagcggactaactgcggttgcagggaaatcgccacgtcggtttcacggtcgccgccggccacataggcgccgacactgatcaggtcacgactctgctgataacgcgaccacagttgtttgaaatactgcgcacgctgcatgtgctccggcgaaaccaccgccggcatcacccggctgatcgacgcttcgatgtcgatggccggatagtgcccttcctcggccagacgccgggacagcacgatgtggccgtcgagtacgcctcgcgccgagtcggcaatcgggtcctgctggtcatcgccctcggacaacacggtatagaacgcggtgatcgaaccaccgcccttctccgcattaccggcgcgctccaccagtttcggcagcttggcgaataccgacggcggataacccttggtcgctggcggctcgccgatggccagggcgatttcccgctgggcctgagcgaaacgggtcagcgagtccatcagcaacaggacgttcttgcccttgtcgcggaaatactcggcgatgcgcgtgcagtacatcgccgcgcgcaaacgcatcaacggcgcgtcatccgccggcgaggcaaccaccacggaacgtttgaggccttcttcaccgaggctgtgctcgatgaattccttgacttcgcgaccccgttcaccgatcaggccaacgacgataatgtcggcttcggtgaagcgggtcatcatgcccagcaacaccgacttaccgacaccggtaccggcgaacaggcccagacgctggccacgaccgaccgtcagcaaaccgttgatgcaacggataccgacgtccagcggctcgctgatcgggtcacggttgagcgggttgatcgtggggccgtccatcggcacccagtcttcggccttcatgccgcccttgccgtccagcgcacgaccggcgccgtcgagcacgcgaccgagcatgctcatgcccatcggcaaccgaccggtatcggccagtggcaccacgcgggcgccgggggcgataccggcgacactgccgaccggcatcagaaagactttgctgccggaaaaccccatgacttccgcttccacctgcgaggggtgatagctgtcgtcattgatcaccagacaacgtgtgcccatggcagcgcgcaggccttcggcttcgagggtgaggccgaccatgcgcagcaggcgaccttcaagaatcggcgcgccggcaatttcaaccgcctcggcataactgctcaggcgcttggcgaaactggtgcgttcaaggcgcatcgggttcgtccgcgagcggctcttcagacgtggccgccggtttcacgtcttcggggatatccagagtcagatccgcctcggccgggtgcaaggcttgctcgtgcaactgatcgaacaattttgccatgacctgggccacgcgggtttcgatgctggcatcgatgcggctgtgctcggtttcaacccggcaaccacccggcaacagcgattcatcttcgacaatgcgccaggtttcctcatgacgttcgcgcaaagccttggcttgctcgaagtcctgcggattgacgtacaggcgcacgttgtcgacgcccagcggcaacagcttgagcgcatcgcgcatgacgtgttcgatctggctggaatcgatggccagttcgcgcttgatcacttgtttggtgatgtgttgcacgaggtcgaccaacgacttttcgatctgcgtgtcttgctcggcgatgggctcgaacagattcgccatcaactgctcaaggctggcgagtttggcggtgagcgccacctcggcttcttgacgcaccttgagcgtggcactgtgaaaaccttccttttcgccgatgccgaagccctcgttgtaagcctcctgacggatgctttcgagttcttccagagtcagtggctggacttcttccagcggcacttcttccatttccggcggttcgggctccggttcaggctcgggttccggcttcggcgggtcgaagctgggcatggcccaggattcgaaaccacggacatcgcgggcacggatcagatccgtcacatcgtcgtcgtgcttgtccatgggcttagatcatttcctcgccacctttgccgccgagtacgatttcgccggcttcggccatacgacgggcaatggtgaggatttctttctgtgcggtttcgacgtcgctgacacgcaccgggcctttggcctcgaggtcgtcgcgcaacagttcggcagcacgtttggacatgttcttgaagatcttctctttgacgccctcgtccgaacccttgagggccagcaccagcacgtcggaagacacttcgcgcagcaacgcctgaatgccacggtcgtcgacatcggcgaggttgttgaacacgaacatgaggtcttcgatctgaccggacaggtcttcgtcgacttcgcggatcgagtccatgagctggccttcgatcgagctgtcgaggaagttcatgatgtccgccgcacgcttgatgccacccagggtggtgcgcgaggcattcgagttgccggagaactgcttctcgagaatctggttgagctctttcaatgctgctggctgtacggtgttcaacgacgacacgcgcaggatgatgtccagacgcactttgtggtcgaagttgccgagtacttcaccggcctgatccgggtcgaggtacgcgaccacgatcgcttgaatctgcgggtgctcgtaacggatcacgtcggcaaccgcgcgcggctccatccatttcaggctgtcgaggccactggtgttgccaccgagcaggatgcggtcgatcaggccgttggccttgtcttcacccagggcctgggtgagcattttgcgcacgtaatcgtcggaaccaacgccgagactggtctggtcgccgacgatgtcgacgaactcgctcatgacctgttcgacttgctcgcgatggacgttgcccatctgcgccatggctacgccgacgcgctgaacctctttcgggcccatgtggcgcaacacttgtgcagcatcggtcgaacccagggacagcagcagaatcgcggctttgtcgaccttggtcagtttgacggctgcggctcggttatcactcatctgcgttaatccactctttcacgacctgagccacacgacccggatcctcggccacaaggctcttgattgcattcagttgcgcgtcataaccctcgctcgggctcggcaacagaatgctctgcggaccaccgaggctcacgcggtcgttggaaagttcgccgtccaggccgcccatcccgccgagttccacgtcgctgccaagaccggccagctccttgcctttgccgccgccggtaatgttgttgagcaccggacgcagcacaccaaacaccagcaccaggatgaacaacacacccagcacttgtttgacgatgtcccagaaccatggctgggagtagaacggaatatcggcaatcacttcaccgcgctcggcggagaacggcatgttgatcacgctgacgctgtcgccacggctggcgtcgaaaccgacggcgtcctgcaccagacgggtgaagcgcgccaattcgtcggcgctccacggcgcacgggtggtttcaccgttggccgcgttgatcttgacctgatcgtcgaccacaaccgacaccgacagacgattcaggcgaccctgctgctgcttggtgtggctgatcgaacggtcgagctcgaagttcttggtcgattgttgacgcttgtcggccgggtacggcgcgagcattggctggccggtggccgggtccatgatctgctgaccgttggcgtcaaccaatggctgacctggctgcaccatgctggccggcgcggctgcgccaccggtggtttgcggcgcagaagccggcgccggtggctggttgctcagggcacccggcacaccttgcgggccattgctggcggtgcgttgttcgttgaccgactgctcgctgcgcaacgccggttgatccgggttgaactgctcggcagtggattcgacggcactgaaatcgacatcggccgagacttcagccttgtagcgatcgttgcccagtaccggttgcagaatgttgtgcacgcgctgagtgagcatgctttccatgcgacggctgtaatcgaattgcttgccagccatggtcatttcagagttttccgcctgatcagagagcaggttgcccttctggtcaacgacggtgatctgcgatttgctcaactcgggaacggaagtcgccaccagattgatgatcgcaacgacctgacccggctccagcgaacggccgctgtacagctcaaccagcaccgaagcgcttggcttgcgttcgtcacggacaaacaccgagctcttcggaatcgccaggtgcacgcgggcacccttgacgttgttcaggctggaaatggtccgcgccagttcaccttcgaggccgcgacgataacgggtcgcttccatgaactggctggtgcccagaccctgttccttgtcgaggatttcaaaaccgatgttgccatcgctgggagtgacaccagcggctgcgagcttgaggcgcgcacgggacagatcatcggccttgaccagcaaggcaccggagttcggttcgacggtgtaagggatgtcggcggaggccagggtatccatgacctgcttggcgtccatgccggcaaggctgccgtacaacggacggtaatccggctgctgcgaccacagcaccacggcaaagccaatcgccacgctcgcagccaggccgaccaacaggcccacctgacgcagcatggtcatctcggagaggttttccaggaaggacaagccgaacagcggcggtttgccgtctatcggggaggccttggccggaacattatcggcgactgcttctgccatgactcaatctcgtccttataccggcatctgcatgatgtcttgataagcctgaaccagtttgttgcgcacctgggtcagagcctggaacgacacgctggctttctgcgaagcgatcatcacgtcggtcagatcgacaccgcttttgcccacttcaaaggcgttggccaactgagtcgacgcggtctgggtatcgctgactttgttgatcgcctgaccgagcatgtcggaaaagctgctgcctcccagctcagggacagcggtcgtcgatttcggcgcagacatggcatccactttcatggcctgcatgtccatcatcaaccgattaaattcaataccttggctcatggtctactctcttgggcggcccgcaattttttgacactcactcggcgggtacacaggtattagcaacaagggtgccagctcacgggcaccccttcagaaaagcgtttgcaatgcatgacgccacggatcaagtggcgaacagataaccttcgacgtccatccccgcatcgcgcatttgcgcgagtttgtagcgcagggttcgcgggctgatgccgagtttttccgctgcctccttgcgacggccgcgctcggtgcgcagggtgtcgatgatcatctgaaactcccggcggcgcaggtcatcgcccaatgccccggcggaatccacgtcgatttccacttcacgaaccacggtttgcgcgggcgctgcgaccggcaacgcggcgaacgtcacggcaccggcgagacagaaatcctgcggctggatcaaaccgccctgctgcagaatcagcgcgcgctgaatcgcgttatccagctcacgaacgttgcctggccacgggtaagcggtcaggcacgcttgcgcctcaggcgaaagtttcgccgcggcatgcttcattttattgacgtgtttggccaacaagcgctcagccagcggcaagatatcggcagtgcgctcgcgaagtggacgccaggccagggggaaaaccgacagacggtagaacagatcctcacgaaaacgccccgccgccacttcgcccgccaagtcgcggttggttgtcgcaaccacacggatatcgagggtgatcggcttgcgcgcgccgacgcgctccacctcacgctcttgcaacacacgcaaaagcttggcctgcaggccgaggggcatttcggaaatttcgtcgagcagaagcgtgccgccgtcggcctgttcgaacttgcctgcctgcgcggcgatggcgccggtgaatgaacccttctcgtgaccgaacaatgttgcttcaagcatgttgtccgggatcgcggcgcagttgatggcaatgaacggttgattggcgcgatgggattgctggtgaatgtagcgcgccagcacttctttaccggtacccgactcaccagagatcaacacggtggaatcgctgcgtgcgactcgcgccgccaattcgagaagctgtgcactgaccggctcgacggcaatcggaccttcgctttcgcttgcgcccatattgcccaacgcatggcgcgccaccagatccagcagcgctttgggctcaaacggtttgaccagataatccgccgcgccttggcgcatggcatcgaccgcgcgttcgacggcgccatgggcggtcatcaacaacaccggcaattgaggctggcgggcccgcaacaacgcgagcagttgatgaccatccatgccgggcatgttgacgtcgctgaccaccagactgaacgcctctcgcgccaccgccgtcaacgcgtcttcagcgcaaccgaccgcatggtaatcatggccggccagcaacagcgtatcggccagcgcctcgcgcaaagaacgatcatcctcgaccagcaaaaccttgatgcccatgacctttactcagctccctgtacaacggaaaacagcggcaggatgacctgcgcacacgtgccacgcccaacccgcgaacgtagctgcaattctccctgatgcgcccgggccaccgccttgaccacggtcaggcccaggccagtaccggtcactttggtggtgaaaaacggttcgccgagccgcgccagaacagcgtgctcgatgccgctgccactgtcgctgacgctgatgcgcaaggcgttgtcgcgggtatagcagtgcactttcagccgaacatcgccggcgctggcctgaatcgcgttttcgatcaggttcaacaacgcgccgaccagagtgtcgcggttgcacagcaactctccgacatgactgtcgcactgccagcggattggcagatcctgcacatgagtcaacgccgccgcttgcagggcctgcatcaaggcgccgggagtcaggcgatcggtcagcggcaattcaccgcgagcgaataccagcatgtcgcgcacctggtgttcgagctcatggaggcgctctttcaggcgcccggcgaaacgctgctgcgtggccaccggcaactcctgctcagtcaaatgactggcgtacagcagagcagcggacagcggcgtgcggatctgatgagcgagcgaggcgaccatgcgccctagcgatgacaggcgttcatgccgtgccaattgatcttgcagatgacgggtttctgtcaggtcgttgagcagcaccaactgacccggttcggcgtccagcgagcgggtggcaatcgacaggcgccgaccgtttttcagggagatttcatgaccatcgtcttcacgcggggcgaagcagcgtgcaatcacctggcgccacagttcgccttccagtggcaggccaagcagctcaatggcagccggattggcttcgcgcaccatgccgtggccgtcaatcacgatgacgccaccgggcaatagatcgaggaggttttgcagacggttggccaggcgttctttttccgccagttcctgcatgcgctgggcactgaccaccgccagctcacctttgagctcggtcacccgcgcctcgagcatgctgtaggaatcagtcaactggctggacatctgattgaacagctcgaaagcctgctcaagaccctgccggcttgcctgttctacggaggacggttgcccctcgggactggaggcagaagacatctgggcggctgggggcattgtgcttctcgcttggctgaccgtcagttaaacggaacgttgcgagggctgtagcaatacccgtgcctaaaaaaaaccgcttataaatgaagcagttgaaaaacaggcgtcaatcatccgcctgttcatctccatcgcgccggctcatgccgtacttgcgcatcttctcgaccagcgtggtacggcgaatacgcaggcgctctgcggcacgcgccacaatgccattggcatcgtccagcgcctgctgaatcaggccctgctccagaccaccgaggtagtccttcaggtccaagccttccggcggcagcatggcattggcggtgaagtccggcgtatggccgttgatggccacgcgctcttccagatcgctgcgcaggctgtcgaccatttgctcgtcttcgtcatcgacgtagcggaatttcttcggcagctcgaccacaccgatcaccccgtacgggtgcatgatcgccatgcgctcgaccaggttggccagttcgcggacgttgcccggccagccatgacggcacagcgacatgatcgccgccgagttgaagcggatcgaaccacgcttctcgtgctccatgcgcgagatcagttcgttcatcagcaacgggatgtcttcgacacgctcacgcagcggggccatctcgatcgggaacacgttcaggcgatagtagaggtcttcgcggaaggtgccgatctcgatcatgctttcgagattcttgtgcgttgcggcgatgatgcgcacgtcgacgctctgggtcttgttgctgcccacgcgctcgaaggtgcgttcctgcagcacgcgcagcagcttgacctgcatcggcagcggcatgtcgccgatttcgtcgaggaacagcgtcccgccgttggccagctcgaaacgcccggcacggctggtgatcgcgccagtgaaggcgcccttctcgtggccgaacaactcgctttcgagcagctctgccgggatcgccccgcagttgaccggcacgaacggcgcgtcgcggcgcttggagtggtaatgcaggttacgcgcaaccacttccttgcccgtgcctgactcgccaaggatcagcacgctggcgtcggtgtcggcgacctgctgcatcatctggcgtacgtgctggatcgcccggctggtgccgacgaggctgcggaacagattgggttcgcgatgacgaccgcgctcgcgggcctggtcatacatctcgcgatagacctgggcgcggtgcagcgaatcgagcaatttgctgtagctgggcggcatttcgagggtcgaaagcactcggcgacgctggtcatcaggcaagtcaacggaagaattatcgcccatcaacaaaaccggaaggaactcatcccaggttgagagtgtctttagcaagcccaaaagcgcgccaggagcattaaccgtcccgatcagtacgcaaatgacctcacgactagacgacaaagagccgactgcctgctgccagtcatggctgccgcagggtaaattttcttcaccgagaaaatttagaatcaccgccaggtcgcggcggcggacgctatcgtcatcgattagcagaattttggtttcacgccacatgcaatagcaacttccctagtcaactcaatgcccgaaaaatggggcaagcgacacgcttgcaggacaccatgtgcctgtagacgcctgaaatctgaaaacagccactagttaagtcaaaaaaccgtgcacagtcaaatttatggcgcacatgtctggattaactggaggttaattaaccaaacagatggtaaacctttgccgccttctgcgcttgggtgatctgcgacatctcgttggctatcgcctgccgctcacccatggccacctcaagaagctccttgtagacatggagcaactcctcaagattatcgcgcaacgcgacttcatccagtgcagcttcagccatgacgtcttccatgcaggaacggcaagccagatccagctcaccaatagcttcccaattgcgctcggccaaggcagtgaccaacgcttcacgggtatcggcaattcgctgcaatacaagactcatggtgctctccttaaaactgggggcccggcggagcaatgccgtcccagccttccttcacagtgcgcagcaggccggcaatctcgtcgagaatcttcgggtcgctcttgacgttggcttcggccagtcgcttcatcatgtaaatgtagagctgattgagctcacctaccgaatcggcgctgttttccagatccaggccttcacacaagccaccaatgatgccaacggccttgctgatggccgtgcacttggcaggaacatccttgcgctcaatggcgcccttggcctgagcaatgcgctccagaccgccttccatcaacatttgcaccagacggtgcgggctcgcttcggacgtctgtgcgtgtgcgccgactttctggtattgccgaagggctaacatcggattcatgttctacctcattgccacaatgactcgtatatccagtgtatcgccaacgaatcagagaactttagatcaaaagacaaaaacccggcgcacgccgataaagcgtagccgggtttttgtcgtgcacgtctgttacttcgcggactgctgagcgttcagcgaggtgaagaacgaggtaatgctgctcgccgtcgccttcatctgccctaccagcaagtccatggcgttgtacttggcagtcaacgttttggtcaggttggcaactcgcaagtccagcgccagttgctggtcggtcaggcttttggtgttcttggtgagaatggccatgcgctgatcaagcagaccggtaccgctgatgttacctgccgccggcttgaggtacgggtcgaccgctttgctcatacgcgccaacagaccattggtgtcgtcggtgccggtgaacaactgctgaacctgaccggtcatgcctggctgggccatggttttggtgaaagcgctggtatcaaacgtcaggttaccggtgttgcgatcggtcattacacccaactgcgacagcaccgccaacggaccgccagcccccgtgttggtcaactcggcacgcacgtcagcaatcagcgtgcgcggcatcgcgtcgccggtgaatgccgcttgcacggtcaacttgccatcggcatccggcgtcgccttggacagcgtatcgatggtggtcttcaaggtgttgtaagcatcgacgaacgattgaatcgatgtctgcagacctttggtgttggcatccacggtgacagccgtaggcttgctcggcggcgtgccctcactgaccgtcgtcaaattcagggtcaagccactgattgcgccgctcaccgtgttgcttttgctggtgacctcaaggccgtcgatggtcagcttggcgtttttcgcaacgccgttgacggcgcctgaagcgcctgcagccggactcgcgcccatctcctgggtaccatcgatttccagaccggcaataccgctgactttgaggtcagagccttcgccggtcttgctcgaactgattaccaggcgcgaagcaccggtactgtcggtcacgatgttggcagaaatgccgttggcgccctgagccttgttgatggcgtcgcgagtggtctgcaacgtggcattggccgggatatcgacattgtaatcagtgccattctgactgattttcagggtaccactcggaatggcactggcggcaccgccggcgaaagaggcgctggcgattttcgagcctgtggccagctgactgacaacaacgttgtaattacccgaaaccgcagtactgtcggaagtagcggtcaggttggtgttgctggaagtcgcggtgaagccggcaaatgcaggattggtcttgctgctcagattggtcatcgccgtctggaacgcggtcaatgcgctcttcaacgaaccgataccggaaatcttcagcgtgttggctttggtggcggtatcgatctgcgtctgctttggcgccttgtcggcgttgaccagcgcggtgacgatcgcaccgatgtccaggccggaacccagtccggaacccggtagaattggacttgccatgtgcatctcccttcagattgttgccattcttttgaccgttacaggcgtcctgagaatggacaaacattattcatgccagctatcagactttagcgtcgaacaacacgtgactcgcattggccagactgtctgccagcttgagggcttctgcggagggaatctgtcgaacgacctcacccgtctcgcttgcgatcaccttgacgatgaccttcccggaatgctcgtcgatcgagaactccagattgcgcttgatcgattgtacgaatttctcgatctcctgcaccgccagtttcaacttggcgtcgtccgtaacctgactcttggcagcgaccggcgcttcagtcttggcaactttcggcgtttctgacggtttgtcagcaaccggcgtgactggcttgggagccggataagactggttaagcttgacgctcatgtccatgctcatcacctcctaacgtaaaagggcgagagagcacgacaagcgcactcccccgcccaaactcgatccgaaattactgaagcagcttcagtacagcggaaggcagttggttggcttgagccagaacggaggtcgaagcctgctgcagagtttgctgcttggtcaggttagcagtttccgcggcgaagtcggtgtcttgtacacgaccctgtgcagcggtggtgttctcaacgatgttctgcaggttggagatggtgctggtcagacggttttgcgaagcacccaggctggcacgggtatcaccgatcgcagcgatagcagcgtcgattgcagtgatagcgttgtcgatgttgctaccagcggtagcagcgtcagtaccggtcagagccagagtacctttgtctacggacaggttgacggcgtcgaacttggagctcagtaccaggtcgatgtggttagcagtaccggtgtttgcgccaacttgcagagtcacagtaccagccgaaccgtccagcaggtttttgccgttcaggttggtggaagctgcgatacgggtgatttcgtccgacatgtcggcgaattctttgttggtcgctttctggtcagcagtgccgttggtgccggtacgtgctttaacagccagttcacgcatacgctgcaggatgtcggtagtagcttgcagagcgccttcagcggtctgagcaacggagataccgtcgttggcgttctggatagcctggttgccaccgcggatttgcgattgcatacgggtggagatctgcaggccagcggcgtcgtctttagcgctgttgattttcaggccggaagacaggcgctgcatcgaagtcgacagagcgtcggaagcgcggttcaggtttttctgaacgttcaacgatgtggtgttggtgtttactgttaaagccatgacgaattcctcgttggttgggtactgcggcttccggccctggcaaccgccgggtatggcctagagaaccttcgtaatagttatcgtcgggattgcaggttgcttgagggctttttgaaaaaaatttgccatcaccctgccacccccgcgaaaacaatgacttagccacccatcgcccgcgaaaaaatgacgccataaaaccgactgccgcgcaaacctgcgggccagcgctgtcggcctgctcaggccggaacgctttgcagcaattcgaccagttcatactccatatagtcagccagtcccaaccagtcctggcgctcctggcaatcgagcatttgcgtgagcacctgggtccacatctgctgggcatccgctggcgcggacagcagccactgctgcgctccctcgaagacatcgaccatgctcaacgcagcctcgacatcccgccccagccgaaacagaactgcgcactgacggcattcaccgatacacgcttgcatcgccgtcattgcacgaactcctgattgaactgcgctccggcgatcagcgcgcccgcccggctgctattgaagaactgaacgtgcggatgcgcagcgatgtaacgttccagcacacacagatatccgcgaaagttgagttgggtactgacacgctggccatgcccgtcgcgcacccaatgccgcgcctgactcacacccggacccagctcgccatcattccagccggcgtgggtcttgttcatcgggaaggcgaagtccgcgccgaacaaggtaatgcgcgtgccgcccagttttaccgccagatccaccgccggatgaatcacgctgccacccacatgcagttccccgcgcggatactgctcacgcaattgcgcatacaccggactggccgagtagccgccgtagcgcttgcccttccaggcgcgcaacacctcggggtcactcattggcaaatacaccagcgggatatcgtcggacgcttcgaacggcaaatgtcgaaagctgatgcgctgatcaatggtcaccaccagatccggcacgatgccgtgttcacgcaatggccgataagcggtgtcgacgcagatgaacagcggaggctgtgcctgagcctggatggccgccagtgcctgaaaatgcccttcaagcgtcgggccggtgccgatcacatagatctcgcgctcggtgcacatgccaaacaattgcgcgacatcgtcatcgccgagcagcaccggtaagcagtcctgcaagcgctgctgtatgaacggagactgcgcatcgaattcgcgattgttgaaactcagatggacttcattgaccagccgatcgcggatcttcgcgctgaagtcatcggccagcagcatttcggcaggcagcgcaaaaaacggcgagcaaatgtccgacagatcgccggcgtagaacagttcggtacgcggatcttccagccactggcgctgatcaagcagttgcagcaccagcgcgaacaacgcgccgttgaggatgtgcacgtacaaccgttgcagcccttcgcgctccagcagcacaacgggcaaatccccaagagcggtgccatagacgtgcaactgcggcttgtcgggcagactggcggcctgagtctgcgcttcatgaaggcgatcgtgacgactggtgagctgaatgccgttgatgctcagcgtcgagccaagtccctcgaccaattgcgccgcaacggccgcactgtcttctgcctgcagtcgctcgaacagcgccggccagcgccgctgcaacacctcggcattggcttgaaaaaactcgctcatgacgcctcgcgctccccgttcaggcaaaaaaatagcgctcaaggttaaccttgaacgctatttttgtatccgccgtttttgcttcggttcaaggacgatagatgatcgccgagccccacgacaggccaacgccaaaaccgctcagcgcaatacgctgccaatcggaatcgatgacgtgcttttccagcagcaacggaatgctcgacgacacggtgttgccggtctcgaccatgtctttgatgaacttctccggctcgccttcgaaacgccgcgccacggcatcgacaatcgccgcactgccctggtgaatgcagaaggcatcgatgtcatcggctttcagaccggaatcatcgagcagttcgtgcaagtgtgccgggactttgagcagggcaaagttgaacacctgacgaccgttcatgaagaacacgccatcggtgactttcaagtgcggtgcaccggagccgtcagtgccgaacttggccttgcccagcgcccagaccggatcttcgcccatccacgtggcggtcgcggcatcgccgaacagcatggtggtgttgcggtcttccgggtcgacgattttcgaatacgggtcagcggtgatcagcaggccgttcttcagaccggcggcttccatgaagcccttgatcgcgtagatgccgtagacgtaaccggagcagcccagggagatgtcgaacgccgcgacattggtcggcaaaccgagtttgtcctgcacgatcgcagcggtgtgcggcaggccttcttcatcaccgttctgagtgacgacgatcaacgcgtcaatcgattcacgcttcagctcagggttgctggcaaacagcgcattggccgcttccacgcacagatcggaagtttcctgttcagcgtctttgcgtggcagaaacgccgaaccaatcttgccaatgatgaactcttcatccttttcgaattttgcaccttgtgcgtaattgtccacgccggctacaggaacgtagctcgcaatgctttttatgccaatcattacggcttcccaataaaaaaacagcccaagaccaccgctcgcaaggatttcgaggggcgccgacaaacagaaaacggccgccacaacgggcagccacggggagcgcaaagggctatcactggaatcgaaaacgagccaggcgccatctccccgatcaatacaatacagtgaagatgcgcgttatgactcgcaggtcacgctattttgccgattcggtgcagatcggcttattcgaccagcgaccagtccagcggcgtgccgcgcttgatcggcgcacgtgcgcggcggccgaggacggcgtcggtgtgtttgggcggcagaccgagaccggggcgaatcgcccgcagattgtccccggtaaaggtgtcaccggcggccatgtcggcggtaacgtacagcgagcggcgatacaccaccgatttcagttcggcttcggtggcgccgtaacgcacttgacccaaggcctgccaggcacgttcggtttccaccaccagactggccatttctgccggttccagcgagaaactcgcatcgacgccacccgccgaacggtcgagggtgaagtgtttttccactaccgtcgcaccaagcgccaccgccgccaccgacacacccacgcccatcgagtggtcggacagccccacctcgcaaccgaacaactcacgcagatggggaatcgtgcgcacgttgctgttgagcggagttgccgggtaagtgctggtgcatttgagcagcaccagatccttgcagccggcttcacgcgcggcgcgcacggtttcatccagctcggcgatactggccatgcccgtagagatgatcagcggcttgccggtagccgccacgcggcgaatcagcggcagatcggtgttttcgaaactggcgatcttgtaggccggcacgtcgaggctttcgagaaagtccaccgccgtctcatcgaacggcgtcgagaatgccagcatgcccaattccctggcgcgggcaaaaatcggtgcgtgccattcccacggcgtatgggccttttcgtacagggcatacaaagaagtgcctgcccacagactgcctggatccttgatgaagaactcaccttcggccagatccagggtcatcgtctcggcggtataggtttgcagcttcaaggcatgcgcaccggccttggccgccgcttcgacaatttgcagggccacgtccagcgactggttatggttgccgctcatctcggcaatgatgaagggcggcgcatcggcgccgatcgagcggtcgccgatcttgaaactagtcatgcgggtgatccttcaaaacacgggtgaacgcacaggcactctgggtaaacccggcgtcacgaaacacattcagtgagggcagattgtccggcatgacacgggcgctgatgaccgtcagttgcggccagtgtgcaacaacaaacgtttggccacgggtcaacagcgccctgccccagccgaggccgaaacgtccttgcaacaggtagaacgatacttcggcttcaaaaccacgcaagtcataacgcaacaccccgacggcgccgtcgtccgcctcggcgatcaacagcaaccgctgcggattacgcaaagctgccgtcagccagttgaggtgttgcgcccaatcgatcgcgccagtctccggcgaccagcgctgcacggcttgggcattacgtccctcgaacagcaactgcgcatcgtccagcgtcgccgggcgcagcttgagcaccgcgcccgccagcgctgccgcgacgcgctcggcgccgcgaccatcgaccagttgccgcgaacgctcggccaggctctggcgcagaaaatggttgcccacaacaaaaccgacagcgtcacgcaactgctcgacactgacctgctcgcgggcgcccatgaacacatgcgcccccgccgccgccatcacttcaccgttgttctgctggttgttcgacaccgcaatgcagatcgttggcaaacccagcgccgcgcgctcccaactggtgccgccgccggcgccgataaacaggtccgcctcagtcatgcgttgatggaaatcactgacaaaactgtgcaggcgccagttcggccgcgtctcggccaaggcctgcatctgcgcccacgccgggttctcggcgccagcaacgaaatccacctgcaattcgctgaattcagcgagggcgagcatcgcgtgatgagtctgcatcgccgcatcgaagccgccgaaattcaccagtacccggcgagctgtgggtttgatctcgatggccgggcaattgaactcttcgcgcagcatggcgtagcgcgggccgagcaacgtgcggcaaccttcaggcagcagaggtgagtagttttcgctgagtccggacaagttctgattgagcaaaagatcaacgctgtagcgtcgggtcgccagatcatccaccgccgcgatgcgatgcgcccagcggcgtgcagcggtttgccagtgatgatcgaggccgtaatgatcgacgatgatccagtcgaactcggcatggccgcccagcagcagacccagtgcgtcgatatcggcctgccacggcagcatcgattcgatggcttgctgcgggtcttcagcggggtagagatcgggcagcgcaaaggtctcaaacccttcgccgctcagcatatcgagccgatgccccggcaattgccgacaggcaaacgcgacgtggctgccctgcccgcgcaacacgcgcgccagcgtcaggcagcgggcgatatgaccactgccgatggtcggcgaggcgtccgcgcgaatcagcactctcattgcagctctccgccagccttgagcgcggcatacaagtattcggcgcgcttccagtcctcaggcgtgtcgatgtcctgcaccaggtgccggggcagaaccaccggcagactggccggcgaatagaccgcctcaccacgcaaccaggcctcactgcggccccagtaaaactgaccggcatcctgaaacgcttcgggcagatcctgcgagcgggtatggcgaaattccgggtacaacgccttcaaggcgccctgcccgtccagcgtcagcgcacgctgcaccggaaacccgaagctgcacacggaaaacgcaaaagacttgtcgggatgctgctccagcaactcgattccctggcgcagataatgcgcctgcaacagcggcgccgtggcgtacacacagcaggcataatcgaacgccggcaactgctgcaaggcatgcacgatcactgccgccgtgccggtgaaatcatcggccagttcctccgggcgcaggaacggcacctgcgcaccctgcgtgcgtgccacatcggcaatctcggcatcgtcggtgctgaccacgacctgatcgaacaagcctgattccagcgcggtgcggatcgaacggacaatcatcggcacgccatcgaacggcaagagattcttgcgcgggatgcgtttgctgccgccacgggccgggatgattgcaaccttgctcaaggacgtttttccagcaggaaccaggtgacatcgtccgccgggaattgcgggtcacggtgatagacaaagccgtaatcgagcaattgcagatcagcatagcgatcaagcatctcgccagcgaaatcgcgcttgaacaacttgccgctgttaccgcgataggacacttcgaccggtgccgggttgtagtactcggcgatcaaaatgtagcgctggctcaactcatacaactgcgcataagcggtcggcaacaactccggggccaagtgaatcagcacgcctttgctcagtgtcaggtcgtagcggcgctcacgaggaaaatcgaacagcgaaccctgccagatctgtgcaatgttcaacgcgcgcgcctgagcacaggcgctgtcattgatctcgacgccgaacagctcacagcgcggcaacaattgatgcagtgcctgcagattgttgccggcattggtgcccagctcgaccaggctttcaatgcgcccggcgcgactcaacgctttggcaaacaacgccagattggccgccaccagcgcttggccgatattgcgctcaacgtactgagtgccgaactcaccctgccagaatttttcctgctcgctcagattacgcattacacagtctcatccaccgccacggcggtattcattcggtcagtcgacgcaattgctcgactacataatcctgctgctgatcactcagcaatgggtacagcggcaagctgatcgcttcggcgtaatagcgctcggcctcggggaagtcgccctcggcaaaacccagctcacgatagtagggctgcaaatgcacgggaatatagtgcaggtttaccccgatcccggcggcgcgcaagccttcgaacacctgacggtgactgaggctgatgcgatcggtctgcaagcgaatcacatacagatgccacgccgattgcgcttctggctgagggctgggcaacgtcaccggcaaatacgccagcaagcgatcatagcgcgccgccagttcgcgacgccgggcgatgaagtcgtcgagtttgctcaactgcgaccaacccagcgccgcctgcagatccgtgatccggtaattgaaacccagctcgatctgttggtagtaccacgggccgtgactggattcggtcatttgctgcggatcacgggtcatgccgtggctgcgcaagcgttgcaggcgctcggccaggtgcgggcggttggtcaagaccatgccaccctcggcgctggtgatgattttcaccgggtgaaaactgaacaccgtcatcgccgcaaattcgccgcaaccgaccgggcgcccggcataggacgcccccaccgcgtgagaagcatcttcgatcacggtgaagttatagcgctcggccagttcggcaatcttgcgcatgtcgcagctctgtccggagaacgctaccgccaccagaactttcggcaacgtgccgtcacgctcggcctgatcgagcttcgcttcgagggcgaacgcatcgaggttccaggtcagcgcatcgatgtcgacgaaatctacctcggcaccgcaatagcgtccgcaattggcggaagcgagaaaggtgttcggcgtggtccacaaacgatcacccggccccagccctgcggccaggcaagcaatgtgcagcgctgccgtggcattgcacaccgccacagcgaaatcggcttggcaacgctcggccatcgcctgctcgaaacgctcgatgcccggcccttgggtcagccagtccgattgcagcacctcgaccacggcgtcgatgtccgcctgatcgagactctgccgaccatagggaatcatgccgaaagcttcgcgtgcagatcggcgatctgccggaccgagaggaaatgcggattggtgtcggagcgatactcgaaatcttcgctcacggcacgcccctgctcgccgagcttgtcgacggcaaaatcgacatcgacgctggtgaagcggatcgacggctgaatggtgtagtgatcctcgaactcaagggtcatccgcgcatcgtccagcggcaccatcaactcatggagtttttcacccggacgaataccgacattcttgtgcggcagatgctccgccatgccacgcgccagatcgacgatgcggatcgacggaatcttcggcacgaacacttcgccaccgtgcatgcgcgcgaagctgtcgaggacgaactgcacgccatgatcgagggtgatccagaatcgggtcatgcgctcgtcggtgatcggcagctgctccgcgccatcggcgatcagcttgctgaaaaacggcaccacggaaccgcgcgagccggccacattaccgtagcgcaccacggcaaaacgggtttcctgctcgccggcaatgttgttggccgcgacgaacaacttgtccgaaagcaacttggtcgcgccgtacaagttgatcgggctggccgccttgtcggtggacagcgcgacgaccttcttcacgccgttgtcgatggcggccgcgatgatgttctccgcgccgttgacgttggtgcgaatgcattcggtcgggttgtattccgccgccggcacttgcttcaacgccgcggcatgcaccacgtagtcgatgccgcgcatggcctgacgcagacggtcagcatcacgcacgtcaccaatgaaataacgcatgcacggcgcgttgaacgtctgctgcatttcgtactgtttcaactcgtcacgggagaacaccaccacgcgtttgggctggtattgctcaagcagtcgggcgatgaatttgcgcccgaacgagccggtgccgccagagatgaaaatcgatttaccgttgaacataggttgattcctgtccggcacgcttaggcgagcaactgagcccaattgatcgagctgttttcgcccaaggtaaaacctttgccggtcagggccaggttggcgttgtaagccggatcctgcgcgaacgcatcaggccatttctcacgcagtgccgccagtgtttgggcagcctctggcaacgcgccggtatgcagcacctgcaccgacggcgtccacacagtgaggaaaccgttctgacttgccttgaggcacagatcgacatcgctgaaaccgtcagcgaaggtcacttcgtccagcccaccgagagcgttgaacagctctttgcgcaccatcaggcagaccttggacacagccgagtaattctgctcgacggccaaacgctgcatgtagccctcggccgcatgtttttcgccgatgaacgccgaacccaccccatcgttcaggcctagaatcaagccggcctgggaaatcttgccatcgcggtcgaccagtttggcgccgacgatgcccacttccggacgctgggcctggttgagtaacgagtcgatccagttcgggttgacgacttcgctgtcagcggccaggagcaccagatagtcaccccgcgcctgttcgctggcggcgttatacaacgccacttcaccgagcgcctgatcggcacgcaagacattgacgcggggattgcgcaactgacccagccagtcgttgaccgccgccgactgattcgggttggccgccaccagtaattcataacggctgtagcgggttctgagcagcacgccctccacgcaacggcgcagcgctggcaggtcatcactggccggcacaatgatcgacaccattggcagttcggtatgacgataatcgacctgccaagtgcctggcagcgacgaagtgaccttggccttgtagccgcgattgcccaaatgacgcagcaacgccaggcgctcgtgggcattctcttgcactgcagcggcctgggtaatcagcagcggctcatcgaggtgcgccagaccgccgagaccaccctgctcaatcaggcgcaacaacaggtcaaactccagcgccttgctgaaatcggcctgataaccgcccgcttcaaggaaaacgtcgcgtcgaatcagccaatggcgcgccatcagcgatggcacgctttgcagcaaatcaaggttgaaacccggacggaatacatccaccagcgcgccatcttcagtgcgctggatttcatcggtggccaccgcgcgcagatccgtggcggacatcaattccaggccagcacgcaacaggccaccggcggtgaattcatcgcccgcgttggccagcagcaaccagtcgcacggagactgcgcggcgctctggttgagtttgtcgatgaagttgcccggcgtgacccggacaaagtgcaaggtattctgtgcagtggtcgcactctgtggctcgtccgtggtgaagaccacgattttgaaggctttgctgtgcccttcgacgaggctgtcgagggtaacctgcagcttgtcgatgtcgttgtccagatccagcaggaaaatgccgaattgtggtccgccattgttcgccgccagatgcgcggcaatcaacccggcttgttcggcgtccggcttgcgggcagccatccagtcgagcaaacggcctgagcgcattttgttgaagaccgggtagtgttcgacatctgacacgacgtcaagacgcgtcgcccactcagccatttcctgcgcctgatcgtcctcgccgaggatctgcagttgctcggccagacgcttgaccacgcgacggttgaacacgttgctgtcgtgggcctgccacaaacggtcgaggacactttccgccgtatcgttattgcgcgactgcaacaggtactcctggcgggtccagatgccttcgagcttttccagttggatacgaccggccggcatcgcgtgcagcagaaactcgaactgggccagcaagtcaaagaagcgctggttgtagaacggcatctcgacgtattgccgtggcccgaatttgcgctcaggggctttggtcaggtggttccaggtcgactcgaaaatcaactcggccgtcaacgcccgcccggtgaccaggctgtcggtcatggccgcgaaactttccagggcaaacgccttgcgctgcgcctgatcgagatccttgatagcggtcggcaacgaggcgaggaattcggcgaaggcttcgcgctcggccaccgacttggagtcggtgtacgacagcgcgtgatacacctcggtgttgtggtcggagaaaccgacattgatctcgcgcacgacatacgggatcggcaggatccgcgccttggcgttcgccagcaggtaataggtgtggccgatctcctgccattcgaaactggtgcccggcggcaatgccgcgtaccagtcctgaatgatcgaggtgcggcaaacgccatagaacggcggcacgtactgatgcatgaaatcgaggactcgatcctcggcgcgctctgaggcgtagtcttcgcagatcttcttgtcgcggcggtagtagctgacgctgccggccagcgccaggtacatcaggcagtagccgtggcacagaccatagtcgcggttggcttcgaggaagttgaccgactcggccagcgattcgtgcaggatgaagtcgtcgtcggcggcgaacaccatataaggcgtggtcagttgcgcaacgccataggtcagtttggcctgcatgccccagtaggcgaattgcggcaggtgctgatagtcgaccgccgaaaaatcaccttccgggcgctcgggagacgagtccagcaccagaaccttgcaaggcaggctgctgtaatactgcagcgctcgacgcagaaacgccgggcggttgtgggtgatcagtaccaccgtcagcaactcgctcaatggcagcttttgttcagaaacagacttgccttgcataacttctcccacgaccggcgaaaccgcccgaaaaacgctttgataatggaactgattaacgaacccggcgcagataaccgtccgacgcgacggtgatcagcagcttgtcttgcatcgcctgatcaatctcgaaatcgtcgttctctttgaggtaagcccacacggcggttttcgggttgtcgcccgggccccatgggcgatccgggaaggcatccgccggcatgtcttcgaccacggtgtccatgaccacgcaatagctgtcgaccgacaccagcggtgcgtagaaacgcagttcttcgaggacatgctcgtgggtgtggttggaatcgagcaccacgatgactttcttgccttcagcggcctgacgcacttgctcgaccaccgcaggatcaaggctcgagccttcgatcatgctgatgcgtttgatcatcgggtggctttcgatggcttcacggttgtgcgcacgaatatcgcgatcgatgcccagtacttcgccgtggccctgcaactccagcagcgaggcgtagtaaatgatcgaaccgccgtgggcaatgccgcattcgatcaccagatccggcttgatccgccagatcagttcctgcatcgccatcatgtcttgcggcaactggatgatcggacggcccatccacgagaagtggtaggtgtatttgtgcttggccgactggttgtagaactcctgggccagcgccttcaagtccttgtcctggccttgggcaatcacttcggcctggcactccgcctcgaaagctttgattacgttatcgctcattgtccggtctcactgaaaagtcatttgatagtcacgctgccaaaaggcattcgctgcaggcgcatcagcggatgcgttgcgcctcgagtaactgttgtaatcgctcgaccacggcccagaacgccaagggttcgtgtgtcggataggggtaatgccccagattcaaatcgatcgaagcgccacgctcgcgcaggcgttgttcgaccagggcccgcaccgataccggttggccactggcgcaattgattacgccgtcgaagtcgcgttgttgcacaatcgcaacgagataatcggcggcgttttcaatcggtagaaaatcgcgtagctgctcgccggccgacatgttgaacgacggctcaccggcatcgacggcccggtccagtgctgccaacagactgttggggttctgcccttcgccatgcagataaaacaggcgcgcccactgcaaggtgaacggctgttgttgctgcagattctgcaaaaacaggtgcagtgtgtgtttggccagaccgtaaggattgctcggctgtggctcgctgctttcgctgagcgggccgctttgcatgccgtattcgaagcaggtgccggtgaccagcacttgctgcacgcccgcctcgaccgcgcttttgataaagcggtaatcggccatcaggttgtgctcgaaatgaaacagcgcccggtagttcggcaagcccggccacgccagatgcgccagcgcatcgatgccttctaccagcgcagcgacatccagatcgggcgcgtgaatatccgcgctcacaaactcgacgtcgttgatccacggcatgccttgcgccgtttgcgcgttacgcgccacggcgcggacttcgcagccacgtgccagcaatgcggcaaccagatgccggccgacaaagcccgtggctccggtgaccagaaccttcacagcactttcaactcaggcacggcgatcacgaagcgcccgtcccactgacgcacctgcgccagttgctgactgacttcgtgcagcagattccatggcagcaccagcacgtagtcgggtttttcgaggtcgatctgcgccggcgccacaatcggaatgcgactgcccggcagaaacttgccttgcttgtgcgggttggcatccgccacccaggccagcaggtccggtttgaccccggcgtagttgagcaaggtgttgcccttggcggccgcgccgtaaccgaccacacgtttgccgtcggccttggcctgcagcagaaagcgcagcagttcatgcttgatacgttcagcagccggcgcgagggtcgcatagtactcgacggtttttaccccagcatcgagttcggcttgcaactgttgctgcaccgctggctgaaccgggcggcgctcgccgtccttgcgctggacgaacacgcgtaacgaaccgccgtgggtggtcagttggctgacgtcgaagacttccaggccattgcgctcgcacagggtctgcacggcggtcaaagacaggtaggaatagtgctcgtgatagagcgtgtcgaactgcgcgccggccatcagcgtcaacagttgcgggaattcgaaggtggccacgccggtcggcttgagcagcgttgcgaaaccgccgaggaaatcgttgatgtccggcacatgcgcgagcacgttgttggccgccatcagatcggcgccccagccttcggcttgcaactgcgcggcagtctcacgaccgaagaacagttcgcgaatttccaggcctttttcacgagccgcttgcgcggtgctgcgcgtcggttcaacaccgaggcaggggatgccgcgaccggccacatattgcagcaggtaaccatcattggcggcgacttccaccacgcggctatcggcgctcaggccgaagcgctcgaccatctcggcgacatagcgctcggcatgggccagccaggtgctggagaacgaactgaagtaggcgtactcggcgtcgaacaggctatcggcactggtgtaatccttggtctgcaccagccagcattgctgacacaccgcgacctccagcggcacccactgctcagcctgttcaagacgatcggcgtgcacataggcgttggacggtggcgaggtgccaagatcaatcagcggcaggctcagcggtgcggcgcacccacggcagttcatagacgcactccagcaaagtgttgatcgagcgcgggatggctggaatcacgcgctgacaaattattgacaggcaacggccaggcaatcgccagccgtggatcattgaccgacagaccgccctcgtgctccggcgcgtaatcggcgctgtgcaggtaaagcagttcggcgtcctcggtgagggtctggaaaccgtgggcgaacccggccggaatcagcaggctgcgaccgtcgccggccttcagatgctcggcgtgccagtgcaaaaacgtttccgagtcggggcgcagatcgaccgccacgtcccacacttcaccgcgcaggcaggtgatcagtttggcctccggggcgttgccattctgataatgcagaccgcgcacactgcccttctcgcgggtgcaggaatggttgatctggcggatatggaattcgctgccgaacgcactcaggctgccttcgcagaacagccgggcaaagtgcccgcgctggtcttcgaagcgtttgtgccggacgctgaacaggccggccagcggcaacgcctgcaaggaaaactcgctcacagcgcgcctcggtacaggttcaactggccgagggtgacggtgcgcatgtcatcgccgttctgccacgccaggtgccagtcgagggtctgggtcaggcatgcctgcaaggtccagcgtggttgccagcccagcagttgccgcgcgcggctgctgtccagacgcagcaggccggcctcgtgcagttcgcttttttcgatgcgtagtccgcgcgcctgcggccagcggctggcaagcaattcgaccacttcgccaacgctgcacatgtccgcctcacccgggccgaagttccacgccccggcgaattccgggccttggtcgtagagaccggcggccagttgcaggtaaccggccagcggttccagcgcgtgctgccacgggcgcacggcttgcgggtaacgcagggtcaccggttcgtcggcgctccacgctttgagcacgtcgggaatcagtcgctcgggggcgaagtcaccgccgcccagaacattaccggcacgcgccgtggccagggccagaccgtgttcggcgtacttgtcggccggaaaaaacgacgcggcataagactgcgcaagcaactcacagcaagccttgctgctgctgtaaggatcatggccaccaagggcttcgtcttcacggtacggccacagccattccttgttggcgtagaccttgtcggtggtcaccagcacacaggcgcgcacgcaaccgacctgacgaatggcttcaagcaggttcagcgtgcccatgacgttgctggagtaagtacccagcggatcgcgatagccttcgcgaaccaatggctgcgcggccagatgcaaaacaatctccggctcgatgtcggcgatgatttccagcaaggcaccgaggtcacgcagatcgccgcgctggtcgttgatgccttcatggacccgcgccagttcgaacaggctcggatcggtcgacggatcgagggaaaaaccgctgacttgcgcgccgagactttgcagccacagggtcagccaactgcctttgaaaccggtgtgtccggtgacgagaacgcgtttgccgtgccagaaatccgcactcaggcccattgcttccatggggcctccccgctctgccacagcgcttcgagatggttcttgtcgcgcagggtgtccatgggctgccagaagccgtcgtgttcaaaggctttgagctgctcatcctgagccagacgggccaatggctcggcttcccaggtggtttcatcgccagcgatgtatggcaacactttcggcgacagcacgaaaaatccgccgttgatccaaccgccatcaccacggggtttttcggtgaagccgagaacctgatcgccctgacgctccagcgcaccgtagcgccctggcggttgcacggccgtcacggtcgcaaggcggccatgagccttgtggtaatcgaccaactgacgaatgttcaggtcggaaacgccgtcgccgtaggtgaagcagaacgcctcttcatctttcaggtaacggccggcacgcagcagacggccaccggtcatggtttcctcgccggtgtcaatgagcgtgacgctccacggctcgctgtaattctggtgcacatccatgcggttttcgcgcatgttgaaagtgacgtcggaggtgtgcaggaagtagttggcgaagaagtccttgatcgcgtaacccttgtagcccaggcagatcacgaagtcgtgaattccgtgggcggaatactgcttcatgatgtgccagagaattggcttgccgccgatctcgatcatcggcttgggcttgaggtgcgactcttcactgatgcgcgtgccgaggccacccgccaaaattactgccttcatcgtctcccctctcgttcgtcaccgggctgcgcaatgctttcttgagctttgcgggccgtctgcctcaaccttttgccgcttcgggcgccggtgggatgaccgcgagcgctcgttttatggcgatttacgggggacttgcaggaaacgcgccagctccatgagtcccgtgaagaccgggctgcaaggtaaaaaaaagggcaaacccgatgataattatcaggttcgccctccatgcctgcaccttcaatcccgttgcaggatcgacagtgctcgattcagcggtcaaccaaacatggcaaacgcatcgctattggctggcaggttgatgatttgcccgttcgccgtttgaatttgctcaatggtatcgaagcctgcgaaccagcccttgagctgcacaccttcctgcggcgtcgtgcccggtgcgaaactcgagcgatgcagatacagatcatcaccgacacgatcaatcaacagttgggaactgctgatatacgacagcaccagtttgtcctcgcggctcgcgccgtcatcctggatggtcacaagacccggggtgccgattgtgtaaaggtcgttatcctcgccaccgttggcaaaaccgctggacttcaacaccagttgatcgttccccgcaccgccaaacaatgcaaagcccaagcctgtaccggtcagcaggtcaccatcctcgccaccgtctgccatgccgtgaaccacggtgatgacatcgccaccggcctcgccatacacgcggcttcctacatcattgcttgccgtgaaaatggtgtcgttgcctttgccgccatatattgtgtcggcctgcggcccgttgacctgcccgtcgagggagaacggcccgatcgaggaaaccagtccgccgtagaggtaatcgttgccgtcaccaccgaagatgatgtcatcccccaatccaccttccaggtagttgatgccagcatcgccggtcaggctgtcattgaggtgactgcccacgacacgctcgatattgcgcaatacatcgccttgcgcatcgccaccctcgttgatattggtcaacaggttgatggtcaccccgctagtgctggtgatgtacatcgccgtatcttgtccctcgcgaccatcgattacatccgcacccaaacctccgatgaaaacatcagcgagtcgggaacctgacaacgtgtcatcgaagtggctgccctgaaagagttcgatgctggcgaaagtgtcgctcgcggcttctccagagttgacattgctgatcaggtcgagggtgatcgcagcgtccgaaaactcgtaactgatcaggtcctgaccggtgccaccgtcaacgcccatagcggcggcgccaccgtagaagatatcgtcgagccccgaacccttgaccgcttcgataccggtaaaggtgtccccggcaccgataccggaatagacattggttttcaggttgatgaccatcgccgccgtgctgtcgctataactgacagtgtcataaccggctccaccgatgaactggtcggcacccgcgccaccgtacagcgtgtcgttgcccgaaccgccggtgatgacgttgtcgctgtcgttgccgtaaccgataaaggctttgtcgccgatataggtcagacgctcgacgttcaccgccagccgcgtgccacttggattgattgttgttacacgcacctcatcgttaccgccaccggcctgctcgacgatggtcggcgtaacgccggtgttgatgtagtagatatcatcgcccgcgccaccttccaggcgaatggccgtggcggtgtgatcagggccagaagtcaggacgtcgttgaacgccgagccgatcacgttctcgatgccggtcaaggtactgccctcggcatccccgcccttgccgaccgcgccagtgccgaagcgaacttccacattgaccccggcgctggaggtcgaataatcaaccgtatcgacaccgccaccgccatcgaacgccatgccacgaccgtcgccgacaaacatatcgttgaagtttgagcctttgatcacttcgatatcggtgtaggtgtcgcctgccgcgatcccggtatgcacaccggttttcagattgatcgtgacagcagtcgttttgctgtcggtgtaacccacggtgtcgatgccagctccaccgatgaactggtcggcacccgcgccaccgtacagcgtgtcgttgcccgaaccgccggtgatgacgttgtcgctgtcgttgccgtaaccgataaaggctttgtcgccgatataggtcagacgctcgacgttcaccgccagccgcgtgccacttggattgattgttgttacacgcacctcatcgttaccgccaccggcctgctcgacgatggtcggcgtaacgccggtgttgatgtagtagatatcatcgcccgcgccaccttccaggcgaatggccgtggcggtgtgatcagggccagaagtcaggacgtcgttgaacgccgagccgatcacgttctcgatgccggtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagaagtcaggacgtcgttgaacgccgagccgatcacgttctcgatgccggtcagaagatcaccttcggcatccccacccttgccaactgctcccgtaccgaagcgaacctcaacatttacgccggcgttcgagttcgaataatcaaccgtatcaacaccagagccaccatcgatcttgtccgcaccgccgctgcccttgatcacatcattgccacccaaggcgttgatctcgtcatcaccactggtacccgtcagcgtatccgcgccgtttgtcccgttaataacagccattgtttcttccttgccttgttgtgaaccggtaccggttcgcgtggcgatcacgtcatcgcggcgaacaataaaaaactacgaatgtgttgatatcgacaggaaaggatcgcaacttgagccgctgcgaaaaatgtattgggattgatacaaagacgaatacacgacgcaaaaaaaacaggcgactgaaaaagtcgcctgttttttaggtagccggagctgatcgatcaatccgccagccagccctgctcccagtaacgcaggttatcgccgcgcaacacgtagtcgcgcagcacgacttcacgcaactcgtcgcccatgcggtagctggcgtccggatcggccagatgcatgcggattgcctgcagccattcttgcgtggtgttggtcttgactcgcgtgcacggcaggtagccgcggtaggcctcagtgtcggtgcagatcaccgggtaaccgcaggcaccgtactccagcagacgcaggttacttttgcagtcgttgaaaatatggaattccagcggcgccaaagcaagatccagattgaggctggccagttttgccgggtaggcgtcgaggccgatcacgccgtggaactcatgcatgtaaggacgcagatcgtccgggcacatgccgaaaaacacccagtcgacttcatctgccaattcgcgcacgacatctgcgatcaccgccaggtcgccatggtgactggtgccgccaccccagccgacgcgcggttttttcgaggtccggcgctggccgcgcaggttgctccagaattctttggccaacatgttcggcaccacgcggatgtcttgatgcatgtccgacaaggcattggccaatggctgagtcgagaccacgacacggtcgcacatgccgatcgcacgccgcacgatacgctccatttcatacttgtcgggcatattgcgaatatgcgcattgcgatgcggaacatcgatgacgtaatcgtcgagctcatagatgctgcgggcgttgaagtagttgcacagcaccggcatttcgttgaccgatgacacggtataacgaccttgcagaacgatcacatcaggcgccagacgctcgatttcaacaatcggcggcaggtttacgctatagcgaatctgcccctgcacccggcctgccgcttcgagttcgatcagcggttgagtgacacgatagtgcccgatcgcggaagcgttgagcggcaacccgagaatcttcggcagggtgctattgctgaacggactccacccggtgcgcaggcccggctcgagggtgaagctcgaacccgtgtgcttgtgcaacgacagattgggattgtaggcagggtcgcgggcaatgaccggcatccagcgcttgaagaacgtttcttcctgctgattgtgcgacacgccttcttcattgatgaccgcctcgaccggctgcgcgcccagcgccagcaccgcatagggcgtccacaccacaagataaccctgacgggcgacgcgcagagccaggtccacttcatgcagcatgcgcggcagactctgctcatccagaccgtcaaccgcatcgaataccgacttgcgcaccatcaggcaatcggcaccgacggcactgaggtcctgaaccacctgcaggcggaacatgtagccggatgactgcatcgcctgaccataaaacggcagaccggccggcccctgcatacccagcaccagacctgcatgcaacacatagccatcggggttgaagatcttggcaccgacgatgccgacttccgggcgctgggcgtgattgagcaactcgtcgagccagtcaccctgagtgatcacggtgtagggattgagcagcaggacgtattcgcccctcgcctgagccacggcaaagttgcgcaatgcggcgacgttaccctgctgcgggtaggtcagcacgcgcacgcgctcgctgcccagttgcgccatgccgtccagccaggcacgtgcctcggcagtctcgctggcgttgtcgaccagcaacaactcgtactcgctgtacgcggttttttccagcaggctctcgacgcagcgttgcaaggccgcaatctggtcgcgagttgaaataatgatcgagaccaacggccgctgcgcatgccggtaatcgacccgattgagcaactcgacactgccacgacgcagatcgtgggcgattcccaggcgatcaagatgcgtcgacagcaatcgttcgttgttgtgcgtcacggcgggcagcgataaccattgggccaggtcgaaggatgattcgatggcaatctcggccagatgccccaccacctgcgtaccttgatcctcaaccatacgccagagcatgtcgtggggcgcgagttcggtgaacgtcgaatcaaagccgccgagcgccagaaaggtctcgcgctggaatgccagcgcgcggccgacatacggataggtgcgcatcagatccaggttgaaatcaggcttgaatgccggctccgccgactcccccgaacgcaagctgccctcatcgctgtacaggcagtgcatggtgctgttgaaggcgatgcgttcggccatcatcagcaacgccggggccaccagacgatcaccgccgcgcagcagataaaaccagtcagcgccttccagctgcggcagcagttgattgatctgttgcaggtaatcgtcctgcaatggcaaatggaacacacgcccatccagcaccggctcagtgcaatccctggacaataccagtgtcaactcgggtggatagacctgcgcggcgaggctttccagcgtacgttccagcgccgccggactgccctgctcatccatcacgatgggcacgattcgcggcgtggacggccagcccgccagagtgtccggcagcaatctgctctggacgtcgctgagcctgcggcacgccagccattgcgcatagagctcggaaaaactctggctgtcagcgccaacctgccagatctgggcgctctgtttggtaccgagcgttcggctcagcggcagctctgtccagacccggggcgactcatccgcgttgggcaatggcacataacgcgcccaccctttcgcaggcgccgactctccgctgcgcgccttgagcatttgcagcagccattgccgctcgacgagcaaagcatccttcatggcttgctggccactcaggcgatccgggtacagacgctcgacactcagcacatgattggagatcaccgcgttgccgcgtcgcagcaaacacacgaacaaggcgaaatcgaggctcgcgacaaaacagtgacccggctgtgtcagcgccggcagtaactcgacaacgtcagtgcgacggaacattgcgttactgaaaccaccgaggaggttcgacgggaacgtctcgaagagcgccagcaggtcatcacccttgaacaagccactgatcggtgacagaggtgtgttttccagccgtgaaggcaggaccatgtcgtcggcgtcccagaacagacgctgggccagcaccagattgacttcgtcatgatgagcgagcacgtcggcctgacgctcgatgcagctggcgaacagctgatcgtcgtcgcacagaaacttgatgaattcgccctgcgcctgatccaggcaggcctgcagattgccaaccatccccaaggtctgcggattgcgcacgtaacgcaccgccaccccgctctgctcagccaatgccgcgacaatggtctggatttcatcgccacgactgtcatcgcacacaatgatttcaagattgccgtaaccctgactgacggcgctgcgcaatgcccgctcgaagaagcgcggattgaaggcaggaatgacaaggctgacaaggggaagtgaattcacggcggactcgcaagcggcgggaacccgcccggaattgcgagccctctgaaaccgcgaaaaaagacattaaaaactcaagagccgaagttccgggcgcttgcgcgcccgttatcgtcagatcttgttgaacagacccagctggctgatcttgctgaacgccaattgcgcagcctgcaacatggtctgctgcaaggtcaggcgggtcatgacttcggccggatcggaatcgcggatcgaaccctgcgtcgtggtgttagcggtgctcaggctgtcgttggtgacagcttgcatatccagcgactgaccacgggcaccgatcgaagtgaccgcggtgccaatctggttggccgcggcgtcgatgttgccgataccggcttccatggcgccctgcagcttttgcttggcgaccggatcgccatcgatcggtgtgttcagcgcggtaatcatctgaccgagggtgtcgagcacgttctgggtctgatggtcattcggctggatcgaaaactgatcgccggctgccggggtgttacccaaggcaaacgtcacaccggctgcggtcgcgttaccgcccgccacagtgcccgaagacaccggcttgctgtccgcagtgaccggcgccgcgtacaggtcgaacgccgtggcgctggtgaatttgagaaccgcgccgccctgcgggaatgctgcggtgtaggcagcctggtcggtgatgctggaaccgctgatcaccgccgtcgaagtgttgcccgggctacgcgaggtagtgaacgtgtccggggtcactgccagctgaaaactgtgcccggcaatgactgcgtccgggttggtgtctccggccttcaggttgaggttcagctgcatgtcgacgccacggaagctgaagctctggttggcgccactggtgttgctgatcacgccgttcttgctggcctcagcggtcacgtcgttacccagggcgtcagtgatctgcatctgcgtgctgctgacgaaactcacggtatacggctgcccagcggtgaacttggcgttgtaggtggcttcagtgccgatcgtaccgttggacagcacgacacgaccgtcatccaccgccggagcggtgcgggtgacgttggtgcgggcagtgttgatggtttgctggaaagcatcccaaccggtggtgttggtaccgaccgacaggccatcgccgatgcccaggttgatggtggtctggtcaccgttgtaggtataagtgccgtcgctgttttgcgaatacggggcagtgctggttttcgaaccggagaacaggtagttgccgtcggcatccttggagttcatcaggcccagcacttgcttctggatctcgcccagttccgaggcgaaagcctggcggtccttgtcggtgatcgtgccgttgttggccgccagagaaatttccttggcgcgtgccagcgccgtggtgatggagtccagcgtggactcctgcacggtcaatgcacttttggtggtgttgacgttggtcttgtactgatcaagcatcgccgcctgctgacccagttgcagcagacgaccggcgccgaccggatcgtcggaagcggtgttgatgcgcgtcaggctgctcgcctcactggcggtggcaacggccttgttgaagttacgctgatagtccgaagcttgcgttccgtaatactgggcggtggaaatgcgcatgaattacgactccttaaaggctgttgatcagcgtggcgaaagtttcctgcgcagctttgatgatctgcgaagacgctgtgtagtactgctggtatttgaccaggttgccggtctcttcatccaggttgaccccggacaacgagtcgcgggcacctttggcgttatcgagaatagccgaggtcgcagcgctgtcggacttgccttgagcagtcttggtaccgacgttggtgaccagcttgttataggcgtcggtcaggctgatgcccttgctcgccgaaccggtatcgacggtctgcttggtttgcaggccgaccagtgcctgcgcgttgcggttgtccgaagacgccgcaccggtgagattcatggtgaaggtttcgccggacttcggcgtgccgccgaccgtggtctgcacggtgaaagtcttctgcacgttgggcgtgacagaggtgtccatcaccgggttgccactggcatcgacgatgccgactttgaggttcagtgtgttcgcctggccgggaacgatggtgccgctgctgatggtggcacccttggtatccaccagtttgtacgactggctgcccccactggcatcaccgaacaccagtttgaccggcgtcgaattcttcagcgccgcctgcatgtctgcctgggcggtcgggttgtagatattgatggagtcgctgagcgtcggctgagtgtaagtacccaggccggcagcactggcaacaccggtcaatggaccggctgccgcgattttcttcggatcgctgagaacagtctggatgcttgccgccgcgttgcgggtcggcgtcaccttgaagctgtcaccggcgctcaacccaccgccattgagcgacaggctaaagccgtcgatcaccggaggtggcgtggtcgtggtgctgaacgcgcccagatcggtgccgtcggaacgcttgacggtgtagtcggtggcgctggtgaacgtgacctgataatcgctggtggtcagcttgccggtatccttgatggtgacgtcaaggttgcccgaacctgtgctgttgcccgacgccgcgatgctgcgctggctgaccagtgcagcactgttgatgttgttgaacagcgccgcgccgaagtcaccgttcttgtcgatgccttgtgcttgctggctgttgatctgatcagccaccaccagtgcaacacgacccagctcgttgagcgaagggtcgagaacttccttgcgatacgtcagcagaccgcccatttcgccaccactcatcaccgaagtgatgtcgagggtgctcgagccgcgatccatctgaatgcccatgcgcgacggatcgtctttgagcggcacggtgctcaaggtgttggtagtgttgccgatcaccagcggctgaccgctgccgacgtagatgtcgaagctggtgccgcgctcgacgacctgcgcaccggtcagctcggacaattggcgtacggcttcgttacggctgtcgagcaggtcgttcggcgcgccgccgctggtggaaatctcaccgatcttctggttcagagtggcaatcgagctggccagcttgttcacctgagccgccatgtcgccgaggctgccgttgatgctggtgttctggtcgttgagctgcttggcgagggtattgaaacgattggtcagggcctgcgcgccagtcagcaccgactgacgggaggtgtcgtcggtcgccgaggtcgaaacaccctgcatcgaggtgaagaatttttgcagcacgccggtcaggccggtgttggtgtccgacagcatcgaatccagcggtgtggcctgggccagaaacgaggccgactcgctgtcgagcgaagtcgccgtgtgcaactggctttccaggtacgagttgtagacccggcgcacgtcggccagggtggtgcccgtgccgatgaagacgttaccgaactgctgcgaggacttggtgccctgcacggtttgctgacgcgaataaccggcggtgtcgacgttggcaatgttgttgcctgtcgtagccaaagaggactggctggccgacagtcccgacatcccgatattgagcaaactcatggttcagaccttataccttgtgccttataaaggcgtggtggatacacccgccgcagcgtagttttggaaactgttcatctgcttggctatctgcgaaatctttgtcgcgtagttcgggtcggtggcgtaaccggccttttgcaactcgcgtacaaactgttctgggttatcggcagacttcacgacatcttgatagcgattattgctctgcagcaaagtcaccagatcgtggaaactgtccttgtacgaggcgtaggaacggaactcggccgtctccttgaccatctgcccgtcacggaactcgctggtgatcgcccgggccgaatcgcccttccagttgctgcttgccttgatgccgaacaggttgtggctgctactgccatcctgggcgcgcatgaccgacttgccccagccggtttccagtgccgcctgcgccaccaggtaacgcggatcgacgccgatacggtcggcggcttccttggccatcggcaacatggtgttgacgaattcgtcggcagaactgaaggccttcttcgccggcgccagcggaatttgcgccatggcgcggccataaatctgcatctgtccgccgccagctttttcgctttcggcgcgggccagccagtcgccgttgtacaacggcccagagccggtggcgacagcgctcgtggcgcgcggcaacaaggtattcggcgcaggcgtggcgttcgtcgcggccgacggcaccagaccggcgagcagacgatcagccagtttcggaggcaaggccaggcgacgcttgttgatcatcgccatgtcattgctgtgggaaacatcggcggtgttcgacacccgcccggaacgcgatgcccacagcggacgttcgccattgacccgcgacaacggaccgttggtggcggtggtgccggcggcaatcggcgtggccacggcagcggctttcgccctggcttcttcttgcttggcggcggacgcagcggcggcttcacccggggccatcggtctgttcttcgacatctggcgcatcagcacgtcagcgaggccgataccaccgccctcgcgggccatggaaacggccatttgctggtcagccatttcctgatattgcttggccgccggagtgttgagcggattatcctgacccagggtctcggtcgccgaacgcatcgacttgagcatttcgccgatgaacaacgactcgaattcctgcgcaaccttgcgcatgttgccgtcgctgttcttgtcgccgaccttgagctgattcaggcgattgaggtcggagtacgaacccgaatcggcgttgctgaccagactgcctttacgcatatccatgattgccgtcctcagatcacgatcaggtcggcttgcaacgcgccggcctgcttcagagcttcgaggatcgccatcaagtcacctggcgccgcgccgacctggttcaccgcacgcacgatctcgtcaagggtggtgcccggaccgaatttgaacatcggcttggcttcctgttcggcattgacgcgcgagcgaggcaccacagccgtctggccattggacaacgggcccggctggctgacaatcgggtcttcagtgatggtcacggtgaggctgccgtgggtcacggcggccggcgaaaccttgacgttctggccgatgacgatggtaccggtacgcgagttgatgatgactttcgccaccgcctgacccggatcgacctcaaggttttcgaggatcgacagatagtcgacgcgctggcttggatcgagcggcgcggtgacacggatcgaaccgccgtcgatcgcttgtgcgacgccagggccgagcatgtcgttgatcttgtcgacgatgcgcttggcggtggtgaagtcggagcggttgaggttcagcgtcaggctgttgccctggttgaaaccgctcggcaccgaacgctccaccgacgcaccgccagggatgcgaccggccgacggaacgttgacggtgatcttcgaaccgtcgcgaccttcggcatcgaaaccgccaaccaccaggttgccctgagcgatggcgtagacgttgccgtcgatacccttgagcggggtcagcaacaaggtgccgccgcgcaggctcttggagttaccgatcgaggaaacagtgatatcgacctgctgacccggtttggcgaacgccggcaagtcggcactgatcgacaccgccgcgacgttcttcaactgcacgttgcccgagcccggcggcactttgatgccgaactgcgagagcatgttgttgaaggtctgcagggtgaacggggtttgcgtggtctggtcaccggtaccgttaagcccgacgaccaggccgtaaccgatcaactggttggaacgcacgccggaaatgctggcgatgtctttcagccgctcggcgtgtgcaccaaaggctgcggacatcagcgccgcagcgagcatgaggctcttgaagttcaacgtagccacctagaaagggaacagcgggctgaggaagaaacggtcgaaccagcctggctgactcgtatcggcaaacgcaccggtaccggaataggtgatgcgcgcatcggcaacccgggtcgacgacacggtgttgtcggtggcgatgtcatcggcgcgcaccaggccggcgatgcgaaccagttcgtcaccggtgttcagcgttagccacttctcgccgcgcacggcgatgatgccgttgggcagcacgtcagcgacggtcacggtgatcgaaccggtcaggctgttgctctgccccgacttggcgtcgcccttggtcgaacggtcggcgctgtagccggcgttcaggctcaggtcgttgctgccgatcgggttgttcgtcgtcagactggaaccgaacaacgacgtcaggccgatcttgttgtcgctgttcttgtccatctgcgagttggcgttcttgctcgcctgggtgcgctcgttcagggtgatggtgatgatgtcaccgacccggaaggccttgcggtcgctgtacaggttctgctcgaacccggcctgatagatcgagccattgttggcggcagccggcaacggcgtgcgcggcaacaccggtgcgtagtaagggtcattgggcttgggcgtcggtgcgacgcagcccgcgagcgagacgaccccacccaatgccagaacagatacaaagcgtttcatgaccctacctcacggtgttgcaggcagcctcatggctgcctcatagacttgattacagattctgcgttacgaacgagagcatctggtcggcggtggagatcaccttggagttcatctcgtaagcgcgctgagtggtgatcatgttgaccatctcttcaacggtgctgacgttggaaccttccagggtgttctgcagcgtggtgccgaaaccgttcaggcccggcgtgccgatttgcggcgcgccggaagcggcggtttccaagaacaggttgttgccgaccgcttgcagaccggccgggttgatgaagtcggcggtttgcaggttgccgatcacctgcgcggcagggttgcccggaaccgtgatggacacggtgccgtcagtgccgacggtgaagctctgcgcgttgttcggaatgacgatcgcaggctccagcgcgaaaccgctggcgttgacgatctggccattggagtcgagatggaaggtaccgtcgcgggtgtaagacgtggtgccgtccggctgcaggatctggaagaaaccgcgaccgtcgatggccatgtccagcggctgctcggtggtttgcaagctgccggcggtgaagtttttctgcgtgccgacaatgcgcacaccggtacccagttgcagacccgacggcaattcgctgtcctgggtcgactgagcacctggctgacgcttgatctgatacagcaggtcctggaactcggcgcggtcacgtttgaagcccgtggtcgacacgttcgccaggttgttggaaatggtggtcaggttggtgtcctgggcggacagaccggttttggcaacccatagagccggaagcattcaattctcctcgtgcgcctgttttacggcgcgacgttctgataattagctgatctgcaagacccgagccatggcctggtcgtcgtctttggcggtgttcatcatcttgatatgcaactcgaactgcttggccagcgccagcaccgaggtcatttcttccacggcgttgacgttgctcgactcgaggaatcccgacaccagtttgacgttggcatcggccggcgcaggctggccgtccttggtgtaaatcgagccgtcgaggcccttgttcatgttcttgatgtccggattgaccagtttgatccggtcgacttccgccatgacgcgcgggccttcgcccatcgcacgaatactgatggtgccgtcttcgccgacttcgacctgctgctcgggtggcacggcaatcggtccgccattgcccatcacggccatgccgttaccggcgcgcaatacgccgagggcatcgatattgaggctgccggtgcgcacgtagctttcaccgccattggggttctgtacggcaatgaagccgttgccggttacggcgacgtcgaggtcacgcccggtttccaccagggagcccggagagaaatcagtggccggacgctcgctcatggcaaacgcacgcgccggaaagctgtcaccaaacaccggcatcgaacgggcctgttccaggtccttctgaaaaccgttggtggagatgttcgccaggttgttggcatgcgccttttgcgccagtgcgttctggctggcgccggtcattgccacataaaggtacttgtccacactctttcctctgcatgccggacgtttgccgcccaccgctgtactgctgagccataagcaatttgcagaccaacttttttctggcggcgcgagacccggtaaacaaaggacttgagggataacgaaggggaatttgaaatgtatcgaagtcgaaaaaccggcggtgttatgccgcttggcggcaatcccctcgaatgatcgttcccacgctccgcgtgggaatgcctcaatggacgctctgcgtccgctttgggacgcagggcgtcccgggctgcattcccacgcagagcgtgggaacgatcacgtgctgcccggatctttgccgacttcgtattcacgcagcttgttggcaatggtggtgtgtgaaacccccagccgcttgcccaactgtcgactgctcggatgctcggaatacaagcgctccagcaccgctttctcgaaacgcccgacaatctcgtccagcccgccctccagcgagaaatcgccaagcggctgacgcacaccgtaatccggcagacgaatgtgctcggccttcaccgtgccgccatcacacagcgaaaccgcctggaacaacacgttttccagttgccgcacgttgcccggccagtggtaatgactgagccggtccatcgccgccggcgccagtttcggcagcgaacatccgatctgccgactggcctgatcgaggaagtgctcgaccaacggcgtcaaaccgtcgaggcactcgcgcagtggtggaatgtgcagggacagcacgttcaagcggtgatacaaatcctggcgaaactcgccgcgtgcacatagctcggacaaacccacctgggtcgcgcagataacccgcacatccagataaacctcttcatcactgccgactcgacggaagcaaccgtcctgcagaaagcgcagtaatttcacctgcaaacgcgggctcatttcaccgacaccatccaggaacaacgtgccgccggcggtcaactccagcagcccgagcttgccttcggcacgcgcaccttcaaacgcgccagggccgtagccgaacagttcggtttcagccattgattccggcagccctgcgcaattgagcgccatcaatggcgattgcccgcgtggactggcgaggtgacaggcccgcgccagcaattccttgccggtgccggtttccccttctatcaatagcggcgcgtcgagcggcgccattcgacgtgcttcgcgcaccactgcggccatgactttcgagctctggaaaatactgtcgaagccgcgcaactcctgcttgcgcacgttgtagatgcgctcaccgacgcgatccgcgcggtgcagggtcagcacggcgccggccatggcctcactgtcgtcgtgttccgattgcagtggcgcgatgtcggcgagaaagatgtcgccccggaccttgacgcgcataccgttgatccgcgacttgttggcgcgcaccagttccggcaaatcgaaatcttcggcgtagcgcgacagcggaatcccgggcacttcatcgacccgcacgccaagcaactgcgccgcagcacggttggccgcgacgatcgagccgcccatgtcgatcgacaacaccggaaactccagcgcgccgagcaaggcgttcagctccatgtgccgacgttcgctcggcatcagccctacccgcttgacgccgaacaccccggcaatcgcctcgaatttcggccgcagagcctggaactgaatgttgatcaggttcgggcagtgcagatagatcgcattgccgtgctcgccaccgacctcgccgcgcgcgacgttgatcccgtattccacaagcagattgaggatgtcgcgcaggatgccgatgcggttctggcagtggactttgatgcgcatataaatcgcccgaattaacgatgaagaaccttgtaggagtgagcctgctcgcgatggctttgggtcagttgatattgatgctgactgatactccgctatcgcgagcaggctcactcctacaggagaacggcgccggacttttctgtggcggcgcgcagataattgtcaagattatgtgacagtcgctggccttttcaaacctgcgaatcactgtaaatgcgcgataacgcctaaagcgtaacgaatagtttacgaaatccaccgatttttcctacgcgagcgcgtaaccacctactgcataccaccccactctcaggtaattctgaatctatcgctggacataacaagaacgaattcccctagcaggagagcagtatgaagcagacgcaatacgtggcccgcgagcccgatgcgcaaggttttatcgactaccccgccgaagaacacgcggtgtggaacacgctgatcacccgccagttgaaagtgatcgaagggcgtgcctgccaggagtacctggacggtatcgaaaaactcggtctgccccacgaccgcattccgcaactcggcgagatcaacaaggtgctcggcgagaccaccggttggcaggtcgcccgtgtcccggcgctgattccgttccagacattttttgaattgctcgccagcaagcagtttcccgtcgcgacttttatccgtacccgcgaagaactggactatctgcaagagccggacattttccacgagatctttggccactgcccgctgctgaccaacccgtggttcgccgaattcacccacacctacggcaagctcggcctgcaggcgaccaaagaagaacgcgtctatctggcgcgcctgtactggatgaccatcgagttcggcctggtcgacaccccgcaaggcaaacgcatctatggtggcggcattctgtcttcgccaaaagaaaccgtttattcgctgtcgggcgagcctgagcatcaagtcttcgacccgctcgaagcgatgcgcacgccgtaccgcatcgacatcctgcaaccgctgtactttgtcctgccgaacctcaagcgcctgttcgacgtggctcatgaagacattatggccatggtcagacaaggcatgcagctgggtctgcacgcgccgaaatttccgcccaagccgaaagcggcctgagcagaacccgctcgcgacttgcgtgcaaagatagtaatttccaacaagaatcgaattcaggaacagaccatgtccacattgaaccaagcccactgcgaagcctgccgcgccgatgcgccacaagtcagcgacgaagaactgccgatcctgatcaagcagatccctgactggaacatcgaagttcgcgacagcatcatgcagctggagaaagttttcctgttcaagaacttcaagcacgcactggcgttcaccaacgccgtcggcgaaatctccgaggccgaaggtcatcatccgggcctgctgaccgagtggggcaaagtcaccgtgacctggtggagccactcgatcaaaggcctgcaccgcaacgacttcatcatggccgcgcgcactgacgaagtggccaagaccgcagaaggacgcaagtaatgcacttcgacgccatcggccgggtccccggcgacccgatcctcggtttgatggaggcgtatgcgcaggacagcaacccgcgcaaattcgacctgggcgttggcgtctacaaggatgcccaaggcctgacgccaatcccggaagcggtgaaaatcgccgaagcgcgactggtcgaaagtcaggacaccaaaacttacatcggtggccacggcaacccgctgttcggtaaagtcatcaatgagttggtgctcggcgctgactcgaagctgatcgccgaacaacgtgccggcgccacgcagaccccgggcggcaccggtgccctgcgtctggccgccgacttcatcgcccagtgcctgccgggcaaaggcgtatggctgagcaacccgacctggccgatccacgaaaccattttcgccacggctggggtcaaggtcagccactacccatacgtgggcagtgacaaccgtctcgacgtcgaagccatgctcgccgtgctcaatgaagtgcccaaaggcgatgtggtgctgctgcacgcgtgctgccacaacccgaccggctttgacttgagtcacgacgactggcagcgcgtgctcgatgtggtgcgccggcgcaatctgctgccgctgattgactttgcctaccagggttttggcgacggtctggaacaggatgcgtggtcgacccggttgttcgccgccgaagttcccgagctgctgatcaccagctcctgctcgaagaatttcggcctgtatcgcgaccgcaccggggcactgatcgtctgcgcgaaaagcgccgacaagctcatcgacatccgcagccaactggccaacatcgcccgtaacctgtggtcgacgccaccggatcacggtgctgctgtagtcgcgaccatcctcgccgacccggagctgaaagcgcgctgggccgatgaagtggaagccatgcgtttgcgcattgcgcaactgcgcagcggcctggtcgaagcgctggagccacacggtttgcgtgagcgttttgcgcacattggcgtgcagcgcggcatgttctcctacaccggcctgtcgccggagcaagtcaaacaactgcgcgagcatcacagcgtgtacatggtcagctcgggccgggcgaacgtcgccggtatcgatgccacccgccttgcgctgctggctcaggctatcgctgacgtcagccaataacaccgcaataacctgtaggagctgccgaaggctgctcctacagttgatcgttcccacgctccgcgtgggaatgcagcccgggacgctctgcgtcccaacagcggacgcagagcgtccattgaggcattcccacgcagagcgttggagcgatcaatctctcctctgggcctcccctgcggccatctgtcgcattattttgaattaaaagtctgattgtcatttttcctgctgtatcctgcgcaggctttccaaaagcgcggatcgaccagatctatcaacagacttagcgaggagcgcaaccatgcacgagattcctaatctccccttcccaagcctgcacgtacctgagcagacgaccacgcaacaagccggcgcggggcagcccgagccgaaagaagccgttgagagccgtccggccgacaacgaagagtaagacccgtcgtacagaccgtgtggaaagcgctaacatgcgctttccacactgcctgaaacttcgagcccgccatgaccgacgaattctctgaaagccaagccgccgtactgatcggcgccaccgagaaaatgatcgacatctggaaccggctctctcccgagaaacaagccgccctgctcgctcgatttggcagcgaagaaaatgccctggcggcgctggtcaccacgcaactggttgccccggccaagtcctgaagcgaccaccgggtaaatagttttacttttcccgccccagagtgctccgcgtcggtatcataagcagcctatctaatctgccgttcccgtggatcgttacccatgtcgtcctctatgtccgagccccagcgccccctggcggttacgctgcaagtcgtttccatcgtcctcttcacctttatcggttacctgaacatcggcattccgctggcggtgctgcccggctatgtccacagcgatctcggtttcggcgcggtgatcgccggcctggtgatcagcgtgcaatacctcgccaccctgctcagccgcccgtatgccggcaagatcatcgacaaccagggcagcaaacgcgccgtgatgattggcctcgccggttgtggtttgagcggcgtgttcatgctgatttcagcgtggacaccgaacctgccgacactcagcctgatcagcctgttgatcggtcgactggtattgggcagcgccgaaagcctggtgggctcaggctcgattggctggggcattggccgcgtgggcgcggcaaacacggccaaggtgatttcctggaacggcatcgccagttacggcgcactggcggtcggcgcgccgttcggcgtgtggctggtcggccagttgggtttgtggagcatgggcgccagcatcatcttgctcgccgcgctggggctgctgctggcctggccgaaaacaccggcaccgattgtcgccggcgagcgcctgccgttcatgcatgtgctcggcaaagtgtttccccacgggtgcggcctggcgctgggctcgatcggtttcggcaccatcgccacgttcatcaccctgtattacgcgacacagcattgggaaaacgcggtgctgtgcctgagcctgttcggcgccagcttcattggcgcgcgcctgctgtttggcaacttgatcaatcgcctcggtggcttccgcgtggcgattgcctgcctgtcggtggaaaccctcggcctgctgctgttgtggctggcgccggacgcgcactgggcattggccggtgcggcgttgagtggtttcggcttctcgctggtgttcccggcgctgggcgtggaggcggtgaacctggtaccggcatccagccgtggcgcggcggtcggcgcttattcactgttcatcgatttgtcgctggggatcaccggcccactggccggggcgattgccgcaggattcggctttgcctcgatcttcctcttcgccgccctcgccgcgttgagcggactggcgttaagcgtgtatctgtacaagcacaccaccaagtatcgcgaggactagaaatccaccttgccgcgcccggccttgatgctgccgcgcttggtcttcgattcaagccgacgcttcttggagccgagggtcggtttggtcgggcgacgtttcttttcgactttggtggcgctgaggatcagctcgaccagtcgttccagcgcatcggcgcggttggcctcctgcgtacgatattgctgcgctttgatgatcaacacgccgtcgctggtgatgcgactgtcgcgcagcgccagcagccgttccttgtagaactcgggcaaggacgaggccgggatgtcgaagcgcaggtgcatggcgctggagaccttgttgacgttctgcccgccggcgccttgcgcgcggatggcggtcaattcgatctcggcatccggcagatgcacattgttggaaatcaccagcatggagaagcgtccgtattcagagcgtgcaggataccgcgaaaccgatgcgaggcctgacgaagatcccctgtaggagtgagcctgctcgcgatagcggtgtatcagtagacgaatttgtacctgacacactgctatcgcgagcaggctcactcctacaggggttttgtgtgaatcctgaaaatgacaaacccggcacttggccgggtttgttgtttctgcgcgcgcgattatttggcggtcgcaggcaccgcagcttgcgcactgcgcttgttcttgatcacgtagcaaacccacatgaacacgacccacaccggaatcgcgtacaccgagatctgaatccccgggatcaacagcatcacgccaaggatgaacaccacgaacgccaggcagacatagttgccgtacgggtaccacagggccttgaacagcggcgtctgcttcgttttgttcatgtgttgacggaacttgaagtgcgagaagctgatcatcgcccagttgatcaccaacgtcgcaaccaccagcgacatcagcagttccagcgcactgtgcgggatcaggtagttcagcaacacggcaatcacggtcaccgccgccgaagccagaatcgaacgcaccggcacgccgcgcttgtcgatcttcgccagacctttcggcgcatcgccctgctcggccatgcccagcagcatgcggctgttgcagtaggtgccgctgttgtacaccgacaatgccgcagtcagtaccacgaagttgaggatgtgcgcggcggtgttgctgccgagcatcgagaacacttgtacgaacgggctgccgctgtaggaatcaccggacgcattgagggtttccagcaggctgtcccatggggtcagcgacagcaggatcaccagtgcaccgatgtagaaaatcaggatccggtagatcacctggttgatcgctttcgggatcacggtttttggcttgtcggcttccgctgcggtgaaaccgagcatttccagaccaccgaaggagaacatgatgatcgccatggccatcaccagaccgctgacgccgttggggaagaacccgccatgcgaccacaggttggttaccgaagcttgcgggccgccgttgccgctgaccagcaggtagctgcccagcacaatcatgccgacgattgccacgaccttgatgattgcgaaccagaattcggcttcaccgaagactttgacgttggccaggttgatcgcattgatcagcacgaagaaggctgccgcagaagcccaggtcggaatgtccggcgcccagtagtgaatgtacttgccgaccgcggtcagctccgacatgcctaccaggatgtacaggatccagcagttccagcccgacaggaagccggcgaagccaccccagtacttgtgcgcgaaatggctgaaggaaccggccaccggctcttcgacgatcatttcgcccaactggcgcatgatcatgaaggcgatgaagccgcagatggcatagccgaggatcatcgacgggccggcggatttgagcaccccggccgagccgaggaacaatccggtaccgatcgcgccaccgagggcgatcagttgaatgtggcgatttttcaggccgcgtttaagcgtacctgattgcgagggttgtccactcatgaaaaaggtctcacgcaaggtttgatgatgttcagtagacgttgctgcaaggttgcgatttcaggcagccccgatcaaaccccagcgcaggcaccaggagttcagctcatttacaacggtcatgcgtcacctgtttgtttttatctgtgacgaaatcgaacccgaaacgcttgtggcgccacggagtgaacaaggcggtaagccttgagatttgcgcgattacgcagagggtcacagttaaaacgcggcgcattgtacaccgctaaccccctgctgccagaccccgctggatcagcgtggcggttgccgggattgcgtgtgtccgccacgagaacctcgggcggctgcaaaaattgagtcaggcctttgcaagccatcgacgcggacgaggaaaaaaccgtcccacggagagaagtggaaatcagtcacggcgttcattgcgcctccttcttgttatgcacctgcacgacaggcatggggcgcatcacaccctgcaaatgcctttgaaacaagcgcgccagagcctcgcaaggcgcctggcagggaaggcttcggcagcttttccttacagcgcccgcaccgaggttgattcactgggttttaccgcggttttcgtaaatatttctttacgctacgtaacgaataatttcctcttcagagatttctgtaggacgtctgcaaattgacggtagcaagcttgctaatgaaattggtcgctagttttttgtttttaaataagaaaaacgcagcctaaaaacagaacaaaaagtctatttaaattttaaataaataattttttgcattacaaaaaaccttgaactaggttcttcacgtctcgccggccacctcgaccggccagtcacaaccgtgaaagtcatctaggagatcgaccatgcaactggaaaaagacttggacaccgaactgcaactggacgaatggtttgaagcaccgacccacgaggcggctgtggaaatgatgcaagccgacgcggtggttccgttcggcacggcgatgtggcctctgtaagacatcccgggcaggcacgatccggccggtcgtgcccgccgctttcttcacggtcagtcagggaggactcatggataagccccgcgcgatctcgcatttcctttactacctcgaacatcacccagcccttgccggcctcgactcggcaaaggtactgctcggccatacggctgattacgcagcgctgaccggcgccatcgccgaacaggctggcgatcatccacgcttcacgttcagcgcccggcgcctggacctcgacagcaccgcgacgctgacttcggcaatcaccgacagcgatctgtacattttcttctacgactcttccaccctgcccaacccgcgcccagaaggcccggagtttgtccgtgcgctgcaagacgtgatggcggaaaactggaagaagtcgctgctgttcaaggactacggcgagtatttctacgacaccttcagcgtcacgccgcagcggattgccggtctgaacagccatttgatccagcgcatgtcccacgcgaccacgctgagtttcaaggacgatgacggctcatggtttgaaacgccgctgagcagcatcaagaaatggaccgacatcaacggtgtcggcaacttcgacctcgcgccgggtgaaatagccacgcacagcgaggccataaacggccatgtgaaattcaagggcaccttcctcagcaccatcccgtttgcgcgcaagtacggtgtgctggaatcgccgctggagctatggatcgagaattcgaccatcagccgcatcgccactgatgtgccggggctggagcatgatttcaacaaatacctggacgccaatccttcgaaccggcggattgaagagttggggattggcaccaatgaaggcgtgaaggatttgtatgcgcgcaatgccgggtttgaggagcggcattgtggcttgcaccttggattgggcggtggcgccaagggcagtcatcacctcgacctgatcttctcgggcggcgttttggcgctggatgacaagccggtgtttgatgggcgatttgtgttttagggccggcacctgatcgttcccacgctccgcgtgggaatgcagcccgggacgctccgcgtccctctagagccgaacgcggagcgtccgttgaggcattcccacgcagagcgttggaacgatcggtgtgcgccagacgaaaaaaaaacgccaaccctgcggttggcgttttttcattcggcgctaaacccgatcactcaggcttcttgcgaccaaaccccggacgctgaccagaccctgccggtgcgccgcgacgcttgcccgacggcttgtcgccatcagccagcttgatccccggacgcttcggcgcaggcttggccgggcgcttgttggtggtgtctgctggacgatccgccactggcgtgccacgaccggcaggtgcaccacgctcgccacgctcagtacgaccgttggccggacgcggagcgcgctcgccgtcgcgggcaaccggcttgcgacctggacgctcgccttcgatctgcggctcgcggctaggacgtgggccggtcggcgcgccagcggctggacgcagcgtgcgtacgcgctcggtcttgcccattgggcgcgacgatttgcgctgcatacgctcaagcttgtctttgctcttggcgttgagttgcggcatcgccaccggcgtcaggccgacttcagcactgagaatgtcgacttcgtactggctcatttcgcgccagcggcccatcggcaggtcggaattgaggaacaccggaccgaaacgcacgcgcttcagacggctgaccaccagaccttgcgattcccacaggcgacgaacctcacggttacgaccttccatcaccacgcagtggtaccagtggttgaagccttcgccacccggcgcctgcttgatgtcggtgaacttggccgggccgtcttccagcaccacgcccgctttcagacgctcgatcatttcgtcgtcgacttcaccgcgtacacgcacggcgtactcacggtccatctcgtaggacgggtgcatcaggcggttggccagctcaccgtcggtggtgaacatcagcagaccagtggtgttgatgtcgagacgaccgatgttgatccagcggccttctttcggacgcggcagcttgtcgaacacggtcggacggccttccgggtcgtcacgggtgcagatctcgccatcgggtttgttgtacatgatcacgcggcgtaccgattcggccgcctcttcgcgcttgatcaccttgccatcaatggtgatggcgtcgtgcatgtcgacgcgcaggccgagggtggcgtctttgccattgaccttgatccggccctggctgatccaggattccacgtcacggcgcgagccgacgccgatacgggcgaggactttctgcagtttttcgcctgctgggccgatttcctggtcgtctttctgattgatgtcactcatctgggcacctcccggtgtggtctgttcaggcgctctgaattgggcacctgaagcattgaaatctgggttctcggccgaagggatcggcgaagggtcgcgaatcatacgcggatgtgcgccgtcgcgcatcagagactagctgatcgatcgacagttatttctttttccgccgaccggcgccaccaagtttgatcaggcgcagtgcggcttcggccagtacggtgcgcttgtcgtccttgtcgagtttcttccaggccttgatttcacgcttgctgcggccgcagccgaggcagatgtcgtcggtgaatttgcagacgctgatgcaggggtctttggtggaactcatcgccttctccggaaaaacacaaatcctttgtaggagtgagcctgctcgcgattgcggtgtgtcagtcgacatcttcttggcagatacaccgcaatcgcgagcaggctcactcctacagggggttcgcggtgtccttggaatcggatcagtcttcgaactcgcggcgttcggcttcgatcgcttcggccagggcgcgggcttcggcttcttcttcgcttagctccggctttggcgtgggttgttcgagggcagcgacggcggccaacaatttctcgcgggcctcagcgacgccgagaatgtcctcttccggttcggcttcgggcacagcttcgagttcaacttcgatggttggctcggcgatctgtggctcaggctcagactcaacttctgcttcaaccgtcggtgcctcaccatccgccgcatcgcgcagcaaatcgtcgaagtcggtcttgatcccctcctccatgctgtccagttccagcaacagcgtatggaaactggtttcctctttctcctcctcgggctcggcgctggcgtcggccaactcctgcaaactctgcggcaccggtgcgtcgtcaaaatcgagcaccgggtcggtttccatttcgcgcagttcggccaatggcggcaggtcttcgaggtttttcaggttgaagtgatcgagaaacatcttggtagtcgcaaacattgccggtttgcccggcacatcacgataaccaacaacacgaatccactcgcgctccagcaaggtcttgacgatgttgctgttcaccgccacaccgcgcacgtcttcgatctcgccacgggtgatcggctggcgataggcgatcaacgcgatcgtttccagtagcgcacgggaatagcgctgcgggcgctcctcccagagtcggccgacccacggcgaaaacttctcgcgaatctgcaaacggtagcccgacgagacttccttgagttcgaaggcgcggccctcgcaggacttgcccagcagcgtcagggctttcttgaagactgcaggctcaggccgctcgccttcttcaaacagttcaaacaggcgctcaagggattgcggctttcccgaggccaacagaaaggcttcaagcaggggcgccagctcgcggggttcagtcaggttcatgtttcgactcgttattcggctcgggctcgcacgtggatcgcggcgaacggctcattctgcaccagctcgaccaaggattccttgaccagttcaaggatcgccataaaggtcaccaccacacccagcctgccctcttcggcggtgaacagctcgacgaacggcacaaaaccgccgcccttgagccgttccagcacatcgctcatgcgctcgcgggtggacagcgcctcgcggctgacttggtggctttcaaacatatcgccacggcgcagcacttcagccatgcacatcaaaatctcttccagcgcgacatccggcaacagcttgcgcgcgcgggcttccggggcatcgagcttgggcacgatgacatcgcggccgacgcggctcaagccgtcgatgccttcagcagcagccttgaaacgctcgtattcctgcaagcggcggatcagttcggcgcgcgggtcgtcttcttcgtcttcgacagtttcggcgcgcggcagaagcatgcgcgacttgatctcggcgagcatcgcggccatcaccagatactcggcggccagctccaggcgcaccgactgcatcaactcgacatagcccatgtactggcgggtgatttccgctaccgggatgtcgaggatgttgatgttctgtttgcggatcaggtacagcagcaggtcgagcgggccttcaaaggcttcgagaaagacttccagcgcatccggcgggatgtacaggtcgagcggcatttccatgaccgcctggccatagaccatggcaaacggcagctcttgctgagcgccggcctggggatcgacaacggtttccactgcggacattcaggcctcgaccatgaacggcgtcggatcgccgcaaccgacgcggatcacttccgggtcatcgccggtcaggtcgatcacggtggaggctttgatgccgccgaagccgccgtcaatgatcaggtccacctggtgttcaagcgattggcgcatttcgtggggatcgctcagcgggtcttcatcgccaggcatgatcagggtcacgctcatcagcggctcgccaagttcggccagcagtgccagcgcgatcggctggctaggtacgcgcaggccgatggtgcgtttcttcggatgcagcaacagccggggcacttcgcgagtggcattgaggatgaaggtgtaaggccccggcagatgggctttgagaatacgaaaggtaccggtgtcgatcttggcgtagttacccagttgcgacaggtcactgcagatcagcgcgaagttgtgtttgtcatcgagctggcgcaaacggcgcacgcgctcaatggcggtcttgtcgccgatctggcaaccgatcgcataggaagagtccgtgggatacaccaccaccccacctttgcggatgatctcgaccgcctgtttgatcaggcgcgcttgcgggttttccggatgtatctggaaaaattgactcacattttctacctgttcagacggcggcaataactgtgtcatgtttgaaccgacaccacaggggtggaaggtcctcgggaaccggccggtactggccgatctcggaccagccgccagggccatggaagtcactgccggcgctgaccagcagaccgaactcacgggcaaggattgccaggctgccgacctgttccgcaggctgatggccattgaccacctcgattgcatgcccgcctgcttgaatatagtcggcaatcagctttcggcgcttgctgcgagtgaaatcgtagtgccacgggtgcgccaggctgacccaggcattggcggcgcgcaacgtgccgacggtgtcttccagcgtcggccaatgcaatttgacgtcaccgagcttgccggcgccgagccatttgcgaaatgcctcggcgcgatcctttacaaaaccttcacgcaccatccagtcagcgaaatgcggacgggccggggcgttgccgctgtcgcccagttcctgctgcacctgccgggcgccttcaagggcaccgggcatgcccttgagggcgagcttgcggcttatttcttccgaccgcagccagcggccatcgtgcaatttggcgatggcctcgaccaacggcgcggcgttgacgtcgaaaccgtagcccagcacatgaatggtcgcgccgccccaggtacaggacaattcgacaccgttgaccagttgcatccccagttcattggcggccgtgcgcgcttcggccaggccttcgagggtgtcgtggtcagtcaacgacaggactcgcacgccgttctcgaacgcacgcgcaaccagaaccgcaggcgccagggcgccatcggaggccgtgctatggcagtgcaaatctacattcacggagagttgtaacctcaaatcagctggcgctatcgcgcgcccatatgtttgttattatgccgccacatccagcttctggctctcactgtgaaacaattcatcgatttcatcccgcttctgctgttcttcatcgtttacaaacttgatccacgggttgtcgacatcgctggccatgaagtgactgtaggcggtatttacagcgccacggcgatgctgatcatcagttccctggtggtgtatggcgcgttgttcatcaaacagcgcaagctggaaaagagccaatggctgaccctgatcgcctgtctggtgttcggcagcctgacgctcgccttccatagcgagaccttcctcaagtggaaagcgccggtggtcaactggctgttcgctgttgctttcatcggcagccacttcattggtgaccgcctgctgatcaaacgcatcatgggtcacgcgctgaccctgccggatccggtctggacccgtctgaacatcgcctggatcgcctttttcctgttctgcggcgctgccaacctgttcgtcgccttcaccttccagagcatctgggtcgatttcaaggtgttcggcagcctgggcatgaccgtgctgttcctggtcgcacagggcatttacctgtcgcgccacctgcacgacgccgataccacaacaccaaaaaccgaggactgacatgctctacgcaatcattgccaccgacgtcgccaactcgctggaagcacgcctggcagcacgccctgcgcatctggaacgcctgcaagcgctcaagggtgagggccgcatcgtattggccggcccgcacccggccgtcgacagcaatgatccgggcgcagcgggtttcaccggcagcctgatcgtcgccgaattcgactccctgagcgctgcgcaggcgtgggctgacgccgatccgtacatcgccgctggcgtctacgccaacgtcgtcgtcaagccgttcaagcaagtcctgccgtaactttcctgcgcaagtctctcccacgcgatgaaccttgtcggttcatcgcgttctcaatcgctcattattctcgtttgcctgccgacaacctgcccaatatccatttggaagcaggtgtagcgatgcgcaagggtccgttgtgtctgatgttggtctcgttgtcgatgatgacgcccgcccatggtgaggaatccaccgaaggcggcagctccacgccattgtcgctgagtgccggcagccagatcaccgaactgcagcagcgcctcaaggccagcgagcagcaacgggaagaattgagcaaacaactgcaaactgccgacaacacccgcgaaagcgcccagctcgcccggctgcgccaagagaaccagcgcctcaagctgcaactcaaggaagcccaggccagcccggtgccgcgactgttgaccgaccagcagcagtggttcgtcacgggagcaggagtagcgctattggcgctgctctgcggtatctttgccagtggagcaagccgaaaacgtcggcaatggctaaattgagtgagtcatgagcgagctgttattgattgatgatgaccaggagttgtgcgaactcctgagtagctggctgagccaggaaggctttcaggtccgtgcctgccacgatggccagagtgcccgcaaggctttggctgaaaccgccccggcagcggtggtgctggacgtgatgctgcctgacggcagcggtctggaactgctcaagcaactgcgcaacgatcacgctgatctgccggttctgatgctctcggcccgtggcgagccgctggaccgtatcctcggcctggagctgggcgccgatgattacctggccaaaccgtgcgacccgcgtgaactgaccgcgcgcctgcgtgccgtattgcggcgcagtcatccggctgccgtgtcgactcagcttgagctgggcgacctgagtttcagcccggtgcgcggtgtggtcagcatcgacgagaaagagctgaccctgaccgtttccgaaagtcgcctgctcgaagcgctgctcaagcaacccggcgagccgctggacaaacaggaactggcgcagctcgccctcggtcgcaagctgaccctgtacgaccgcagcctcgacatgcacgtcagcaacctgcgcaaaaagatcggcccccactccgacggccgcccgcgcatcgtcgccctgcgcagccggggttactactacagcctctgaacctcccacttgtaggagtgagcctgctcgcgatagcagtgtgtcagtcgacatgttcttgccagatacaccgctatcgcgagcaggctcactcctacaaagtgtgtttgtcaggtcggacgcgaagcgtctttacccaagctttacgtagcgctgaccgccgctgaccttgatctccgtaatctgaactcatccggaacgtaccgggaacgagacaaggagatacaccatgcgcaagactcttatcgctctgatgttcgctgccgctctgccaaccgtcgccatggcgatgccgcaagacggcggcccgatgggtggcccgctcgacggcccacgccacggcggtcagatgcacggcatgcacggcaaaggcccgtacagccaactcgacctctcccgcgagcagcgcgagcagattcgcaagatcatgggcgagcagatgcacgagcgtaagcaagtggtcgacaaatacctggaaaaactctcgccggctgaccagaaagccatgaaggacgagatggcggccaaccacaagaaagccgaatccgatgtccgcgccgtgttgaaaccggatcaacagaagaaattcgacgagatccagaagaaacaggctgaacgccgcgccgaatgggccgagttcaaggcgtggaaagcgcaacaggcgcaaaaagcgcaataatgttctgacccatggcccatcggccaaacccgatgggcctgttttcatcgatccaaatgtaggagtgagcctgctcgcgatagcggtgtgtcagttgacagatttttgtctgacccaccgctatcgcgagcaggctcgctcctacagggatttgtgtttgttttgaggattttctgtgcgttcactgttctggcgtattctcgcgagcttctggctggccatcgctctggtggcagggctgtcgattctgctcgggcacatgctcaatcaggacgcgtggatcctcagccgtcatccgggtctcaacaccctcgccggcgagtggacacaaacctacgaagcccagggcgaggaagccgcgcaggacatcctcgaacagcgcaaacgccaatatcacatcgacgttcaagtgctcaacgaaagcggcgatccggtggtgcgcggcactttcccccggcgcgcggcggccttcgaagcacgacagaacaacgatgaccgccgtctgccatggcgacgcctgaccgacgagttcaccagtgaaaaaaccggcgacacctacctgttcatctaccgcatcccccaccctgaactcgacgcctggcaccgcgaaagcctgctctggccgttgagtgcgctgggcatcgcactggtggtactgaccctgttcagcttgctcgtgaccttctcgatcacccgcccgctcagccgtttgcgcggcgccgtgcatgatctggggcagaccacttatcagcagaacagcctggcgaaactggccaatcgtcgcgatgaatttggcgtgctggccactgacttcaaccgcatgggcgcgcgtctgcaaagcctgatcggcagccaacgtcagttgctgcgcgacgtctcccatgaactgcgctcaccgttagcgcggctgcgcattgccttggcgctggccgaacgggccaaccctgaagaacgggaaaaactttggccacgactgacccgcgagtgtgatcggctggaagcgttgatcagtgaaattctggtgctggcacgggtcgatgctgacaatgccagtgctgaagaagtggatctgaatgcattgcttggcacgttgcagaaagatgcacaacttggatcgcccgagcagacggtgcgtctcgatgcggatccgcaactgcacctgaagggctggccgaccatgatcgagcgtgcggtcgataatctgctgcgcaatgcccagcgcttcaacccgcaagatcaggcgatcgagatgcaagcctcgcgtcagggtgaaaaaatcatcgtcagtgtgcgtgaccacgggccgggcgtgctagccgaacatctgagtcagttgggcgaaccgttttaccgggcgccggggcagacggcggcgggacatggcctgggcctggcaattgcccggcgggcggcggagcgccatggtgggagtttgacgctggccaatcatccgcagggtgggtttattgccagtctggaattgccattggtgccgggtgcggtggtgcaaccctaagagccgcccgccccagaaaagcccctcaccccagccctctcccagagggagagggagccgaccgaggtgtcttgcgtcagacatcgacctgaaacaccgagttgattatggattcgacagaaccgtaatccgcgtcgattctggattcagcgaagagcgttcaggtcggcgtacctctacagcatcccccaatcagtcccctctccccccgggagagggttagggtgaggggcttttgatcttcaggcgatggcgggccaggcactaacaaactcagccagatcaaccttctccgccacacgcggttctttctgcggtgtgccgaggtaaaggaacgcaattacctcttcgccctccgccagccccaaacccttggctacgtgctgcgaataagccaaatcccccgtgcgccacaccgcaccaatcccttgcgcatacgccgccagcaaaatcccgtgcgccgcacagcctgcagccagcaactgctcggccttcggatacttgacgtgctcctgcagtttggcaatcactacaactaccagcggtgcacgcagcgggccgttgcgggccttgtcgatcatcgcttcggtgacttcgccttcctgcatctgtgcagcctgagccagcaactcgcccatctgctcacgtgccgcgccttcgaccgtcaagaaacgatacggctgcaaatgcccgtgatccggtgcacgcaatgcggcaccaaacagggcttcgcgctgctcggcagtgggggccggttcgaccagacgtggaacggaaacacggttgagcaacgcgtcgagagcctgcatcggccacctcctgaaaaatatgtgcggctattctagctgtatctgccaacaggatgccggtttacatgccctgccccacgggtagaatggcgcccttcccacatcagcccgagcggacttcatggcgttgccgaccttacggatcattggtttcatcatcggcatcttcctgatcaccctggctgtggccatggtcgtaccgatggccaccctggtgattttcgagcgcaccagcgacctgccgtcgttcctctgggcgagcatgatcaccttcgtcgccggcctcgcgctggtgattcccggccgccccgaacacattcatctgcgcccgcgcgacatgtacctgctgaccgtcagcagttggctggtggtgtgtatctttgccgcgctgccgtttctgctgacgcagcacatcagttacaccgactcgtttttcgaaagcatgtccggcatcaccgcgactggctcgactgtgctcaatcatctggacaatatgtccccgggcattctgatgtggcgctcgctgctgcactggatcggcggcatcggctttatcggtatggcggtagcgattctgccgctgctgcgtatcggcggcatgcgcctgttccagaccgagtcctcggaccgctcggaaaaggtcatgccgcgctcgcacatggtggcgcgactgatcgtggcggcatacgtcggcatcaccatcctcggcagcctggcgttctggtgggccgggatgagcccgttcgatgcgatcaaccacgccatgtcggcaatctccaccggcggtttctcgacttccgaccagtccctggccaagtggacgcaaccggcggtgcattgggtggcgattgtcatcatgattctcggcagcctgccgttcaccctgtacgtggcaacactgcgcggcaatcgcaaggcgttgatccgcgatcaacaggtacagggtttgctggcgatgttgctggtgacctggctggtgctcggcacctggtactggtggacgaccaacctgcattggctggatgccttgcgccatgtggcgttgaacgtgacatcggtggtcaccaccacaggcttcgccctcggcgactacagcctgtggggcaacttctcgctgatgctgttcttctatctgggctttgtcggcggctgttccggttcgacggcgggcggaatcaagattttccgtttccaggtcgcctatatcctgctcaaggccaaccttaatcagctgattcacccgcgcgcggtgatcaagcaaaagtacaacggtcaccgcctcgacgaagagatcgtccgttcgattctgactttttcgttcttcttcgccatcaccatctgcgtgatcgccctgctgctgtcgctgctcggcgtcgactggatgaccgcgctgaccggcgccgccagtaccgtgtccggcgtcggcccgggccttggcgaaaccatcggcccggcgggtaacttcgccaccctgccggatgcggccaaatggatcctgtcattcggcatgctgctcggccgactggagatcattacggtgtttgtgctgtgtattccggccttctggcgtcactgatcgcgttcggtgcctgcaacaaccgcgtccggtaatcgccgggcgtggtgtcgaaccagcggcggaacgcgcgaaagaagttgctcgggtcggcaaaacccaacaggtaggcgatttccagcaaggtcatgcttggctgcgccagatattgctcggccagttcgcgacgagtgtcatcgagcaactgctgaaaactcgtgccctcctcctgcaagcggcgctgcaaagtacgctgcgacaaatgcagggtctgcgccacggtatcgcgctttggctcaccttgtggcagcaaccggcacagcacctgtcgcgctttgtgggtcacgcggctttcggaaaatcgtgccagatactccccggcaaagcggtcgtgcaacagcgccatcgcctcgttggcggtgggcagcggcgcctccatgtcagcgcgttcgaagatcagcgcatcgtacggtgcgttgaacaccaatggcgcgtggaaggcttgtttgtagggttccagattctccggctgatcaccctgcaccagcactttgaccggatgcagcgtgcgcccggtcagccaaccgcacagacccaacgcacaggccagcgaggcttcggcactttgccgggtcggcggcaaatggtcgccgtgcacggtcagaatcagcgcgtaaccttcttccagcagacggaaactcaggtcggcactttcagcgatgatccgctgatagcgcaccagtcgctggaagccttcggccagggtattgctcgacatcaatgcgtagccggcgacatgaaacgacgccggtcgcaccactttgcccatattcaggccgatcgccggattgccggacaactcgaccgcccgttgccagagtcgggtcatggagtcttgcgggaaacgtgcatccggatcatccagagccgtgtaatcgagccccagttgcttgaacagtacccggcaatccaggccgtccatctccaatgctttgacaatccccatcgcccagcttgcagaagtcgttcgttcgctcatggcgttattcttttacatgatgggccgcatgttacggcctgatttgcgaaggatactaaagtggcgccgattgtcactggcccacgccaatgatcactctagactcaaataagctacccgcagaacaactcgtcgccagaacaataaccacagagaacgcggtcgtggaaaacatcaagcgtttcaacagcttcgctgagttctatccgtattacctcagcgaacacaacaacagcacctgccggcgtctgcacttcattggcacgacgctggttattttcattctcgcgatgaccatcgccaaaggcgcctggctgcttctattggcggtgccattggctggctacagctttgcctgggtcgggcatttctttttcgagaagaaccgaccggcgacttttcagcatcccctgtacagcctgctcggtgactttgtcatgtaccgcgacatgatccttggtcgcgtggcgttctgaatgagggtcagccaatgaatgccaatgcccgcttcacccatatgaaggacggcacgcaggaagactgggcgatcatcgccgctgacttcagtgcctacgccaaacagttgccctcacggatcatgactcacctgaaattgctcgaaggcgatttcggcggtttcccggtggatcgcctgacccactcgctgcaaaccgcgacccgcgcctggcgcgatggccgtgacgaggaatacgtggtctgcgcgctgctgcacgacatcggcgacaccttgggttcgtacaaccacccggacatcgccgcagcgattctcaaaccgttcgtcagcgccgaaaatctgtggatggtcgagaagcacggggtgtttcagggctactacttctttcatcacctgggtatggatcggcacctgcgcgagcaattcaaagagcatccgcagtttcaagcgaccgccgaattttgcgccaaatacgatgcggcggcgtttgatccggagtacgacacactgccgttgagtttcttcgagccgatgatggagcggttgtttgcacagccgaagaactcgatttacaaggccgcgatggctgaacactcaccagcgtgattatcttcgggaaccgctgcgcggttcatcgcgagcaggctcactcctacagttgaaatgcgtacccctgtaggagcgagcctgctcgcgatgaggccctctcaatcaccgaagaactaggcaagttcggcgactttggcagccctgagctccgcctcacgcgcctgcgcatctgccagccgatacaactcgatcgtgccatcccaatgctcgatcagcgccgtgcacgactccacccaatcgccgcaattgaggtaatccacctcccccaccttgcggatctcggcgtggtgaatgtgcccgcagaccacgccatgcaactcgcgcttaacgcactcatgggcaatggcttcttcaaagtcgctaatgaaactcaccgcggttttcaccttgtgtttgaggtacgccgacagcgaccagtaaccgtagccatagcgcgcacgccaatggttgagccagcgattgagggtcagggtgaactcgtaggccgaatcgccgaggaaggccagccagcgatgatatcgggtgatcacatcgaactgatcgccatgaatcaccagcaaatgccggccgtctgccgtgacgtgtatcgcttcgtcgaccaattggatgttgccgaggatcagctttgaataacggcgtaaaaactcgtcgtgattgccggtgacgtaaatcacttcggtgccgcgcttgctcatggtcagcaagcggcgaatcacattggtatgcgcctgcggccagtacatgccaccgcgcagtttccagccatcgatgatgtcgcctaccaggtagactttgtcggcatggtagcctttgagaaactgcgacaagtgttcggcctggcaatcgcgcgtgcccaggtgcacgtcggaaatccacagggttcgcacccgttgtttgcggctgggtctggcgagctcggcgctggtcatgggcaaccctctgcgatgttttcgccagagtgcgcttgcccggtgaatcgaccatgacaagcgtgagtcagtcctgtgacagcgcagcccgtgccgctcggtgtagactgcaggcctgcccggagatctgttcatgcgcccgatccttaccctgcgtcagtacacccgcgacctgatcgtccacagccacgagcacgcccagttggtgttcgggctgtccggcgcgctggacttcgaggtcgaaggctgtggcagccaggtgcgccagcaaagtttcgtggtcatcccgtccggcgcccatcacgcctgcggcagtcccgacggcagtcgttgcctggtgatggatattcctgacgggcaatggctggtggattcgttgggtgaacatgccgatgccagtcgccgcttgctcgatcagcctgcgcgtttgtcgctggattccgggcagagccaattggtcaactggttggcgaacagcccagtcagcgatccgctgatcgcgcagcaaggcgcggtgttgctgctggccagcctcaatcatgcgcaacctgctgaactcgccgcccgccgtctgccctacgcggcgctggatgcgtacatcgagcaaaacgctgggtatccactgcaagtcgccgatctggcgcgcgttgccgggttatccagcgcgcgtctgcatgctcggttcatggccgaatgcgggcagacgccgatggattacatgcgcagtcggcgcttgcatctggcggtgcaactgctgcgcgatacggttttgcccatgggtgaaattgccagccgcgtcggttacaactcgcagagtgctttctcggccgccgtcctgcgtgagttcggcgcctcacccggccagcttcggcgcgattcccgcgacaaaagacgatagtctgccgacagacttactgacctctacacgcttaaatgtaggagctgccgaaggctgcgatctttgatcgttcccacgctccgcgtgggaatgcagcccgtgacgctccgcgtcactggacgcagagcgtccctagaggcgttaccacgcagagcgtgggaacgatcaaaagcaagatcaaaagatcgcagccttcggcagctcctacagtaaatggtcgttcccacgctgctgcgtgtgatcgatcaacagttgaattgtgtttgcgatagaaggactgcaatgactccgcgtactgccctcggcgccctgcacattggtgctttgatgtttggcctgaccggtgtgttcggcaaactcgctgccgcctcgccggccgtgatcgttttcggtcgtgccgccttcgccgtactcgccctggctttcttcgcccgattcgccagccaaagcgcttggcaaaaactccaggccgtggattggcgacgtctggccctcagcggcgtgttgctggccgggcactgggtgagttttttcgtttcggtgaagatcgccggcgtggccatcgcgaccctgggttttgccagtttcccggcgttcacggtgattcttgaagggctgatcttccgagaacgcattcgcgccaatgaaatcgtgctcgtggtgctggtcagtgtcggcctgatactggtgacgccagcgttcgatctgggcagcggcgcgaccatcggtctgctctggtcagtgctgtcggggttgctgttttccttgctgtcgctgaccaatcgcgccagctccgggcgtattccggcggtgcaggcggcgttgtgtcagaacgtcgtggtagcgctgtgtctgctgccggtcgcagcaccacaattgagcgaagtccgtgcgctggactggttgtggattgccctgctcggcgtgttctgtaccggcgtcgcccacagcctgttcgtggccagtctggcggtgatcaaagcacgcacggcggcggtggtgttcgcgatggagccggtttacggcatcaccatcgcctggctgttgttcaatgaaaacccgaccctgcgcatgctgatgggcggcgcgctgatcattgtcgccatcgtggtgtcggcgcggatgtcaggcgccagcgataaaaaaaccgtcgccgccgaggccgcatctcactgagcgcgatcgttgtggccgaggtcgcggtcagggtcgatctgatcgcgaacccgttgcttcagcaccttggcctcgggaaagccgccgtccgccttgcgctcccagatctgcacgcctgcgcaggtaatgtgaaacaccccgccggtagccggcaccagtgagactttgccgagatcatcggcaaacgtgctgagcagttcctgcgccagccacgcggcgcgcaacagccactggcattgggtgcaataagtgatgacaacttcggctttttctacagtcatgttcgctgaaactcctgagacagagggcgccgctataatagccggctttatcgcttgccccgagactcacaatgcgccgtctgctgttctgcctgctgcttggtttactgcccctgctcgtccacgccagcgtcgaagccaccgaagcttcgcgccccaaggtcggcctcgtgctgtccggcggcgctgctcgtgggctggcgcacattggcgtgctcaaggccctggaagagcaaggcatcaagatcgatgcgatcgccggcaccagcatgggtgcggtcgtcggcggcctgtatgcctcgggttaccagatcgacgagctggaaaaactcgcgctgaacatcgactggcaagccgcgctgtccgacgccccgccccgtgaagacgtaccgtttcgacgcaaacaggacgaccgtgactttctggtgaagcaaaaactcagcttccgtgacgatggcagcctcggcctgccgctcggggtgattcagggccagaacctcgcattgctgctggaaagcctgttggcccacaccagtgacacccgcgacttcgacaaactgccgatccccttccgcgccgtcgccaccgacatcgccaacggtgagaaagtggtgtttcgcaaggggcatctgccccaggtgatccgcgccagcatgtcgattccggcggtgttcgccccggtcgaactcgatggccggctgctggtagacggcggcatgaccgacaacatcccgctcgatgtcgtacgggcgatgggcgtcgacatcgccatcgtggtcgatatcggcacgccgttgcgcaaccgcaagcaattgaccacggtggtcgatgtgttgaatcagtcgatcaccctgatgacccgcagcaactccgaagaacaactggccgcgctcaaaccgaccgacgtattaattcaacccgcactggcagcgtatggcgtcaccgattttggcaaggctcaggacatgatcgacgccggttaccgcgcgacccgaatccttgatgcacgcctggccactcttaaacccacagaatcccaggacgccgaactcaacgccgcacgctcgccaggccagcgcacaccgatcatcactgccatcaaggtcgagaacgactcgaaggtcgacgacgatgtgatccgctactacatccgccagcacatcggcgagccgctggatctgggtcgcctgcattcggacatgggcaccttgtacggcctcgactatttcgagcaagtgcagtaccgcgtggtgcacaaggggcaaaatcacaccctggtgatcagcgcccgcggcaagcgcagcggcaccgactacctgcgcgtgggcctcaacctctcggacgacatgcgcggcgacagcgccttcaacctcggtgccagttaccgtatcaacggcatcaaccgcctcggcgcggaatggttgacccgggctcaaatcggcgacaaacaagagctgtacaccgagttctaccagcccctcgacgtcggctcgcgctacttcgttgcgccgtatgcatcgttcgaggcacagaacgtcgattcggtgctcgataacgatccggtcgcgcaataccgcgtcgagcgctacggtttcggcctcaacctcggtcgacagatcggcaacaacggtgaagtgcgctttggtgtcggtgaggcctggggcaaggctgatgtgcgcattggcgatcaggatctgccaagcgaaagcttcaccgaaggcttctactcgctgaagtactcctacgattcgctggacaacgtttacttccctcacgaaggcaaggacatcagcctgacgctgatgcaattcgaaccaagcctggggtcggacactcggtaccggcagtgggaattcaaactcgacaaagccatgagcagtgggccggacacactgattcttggcggtcgttatggccgcacgctggacaatgccaacgtggtgacgtcgagcttcctgttgggtggcgcacggcagttgtcgggtttccgcgaggatgcggtctcggggcagaatgtcagcctgatgcgcgcagtgtattaccgcaggctgacgccgcgctcctacctgccgctggatttcccgctgtacgccggtgcttcgctggaacgcggtcgggcatggaacaacgacaatgagttcgacagcggctacatcaatgcggcgagcgtattcattggcttcgatacgccgttggggccattgaatttcagctatgggttgaatgatgcgaatgagcaggcggtgtacctgaaccttgggcagactttctgattctttatcgactgaccatttgctatcgcgagcaggctcactcctacatttggagtgcatttcaactgtaggagtgagcctgctcgcgatggcgatatccggtccgccacaaatcatcagaaatcaacgaatccccgccaacaacgtccgcgccgtttgcttcaacggctcatcagcctctttgagcaattcattgagcaatgcaatcgcactgtcgatatcaccgtcgtcgatgcacgtctgggcctgttcgagcttcaccgagccggtgggctccgccggttcggacaattgcagatccagaggttgcaacaccaacgatgattccgaatcagcgaactcattgagaaagtcgttatccagcggctgtgcgtcaggctcgcgaatccattcaagctccgactcttcactggccactggtgcaggcaattcgaactcctgcggcaagacctgcaggcttgaaccgggacccggctcgcccgacgccggctgcgctgaagatggccgactgtcctccagatcccagctggaagccatcgacaactcccccagattcaactcgaaattatcttccggggtcggttgcaccggggcagtcggcgctgctgcgacaacgggcgccaacggcacagcgctgaccagtttcggatgacgggcacgggtgtcgtgcagttgctgttcatcgacaccttgtgcgcgcagatgactttcctgctgatcgtaggcgctgttatcaccctgacggcccaacacttcgagcaattgcaacccaaggtcgcggcgctcgggctccttgtgcgaggcatcacgcaacaggccaaccgcttcaccaagtcgcccatacgccaggtaaatgccaaccgcttccagcacatccccggcagcgggctcttcgcggtggtcggctgcgttgtgagcccggacgtgggctgccggtaccggttcgtctacgtccgctgcatcgggttgcgctgacaatggcagcggttcgcccgcgtgcaactgttgttgccgacgacgcaggaacaaggccgccaaggctcccagcaataacagcaagccgccgagcaacggccagttcagaccgtcgtccgtggtttcgacaggggcaacaacgggagaggccgttggtggcggtgctacgacaggcgctggcggaggtttctgcagctcggcgaggcgggtttgcagctcgccgatctgcttcttgccttcggcgatctgcgtctcttgaatcaacagtcgggctttctgctcgtcgagggtcgcttgcagttgctgattgagcagcacactggcagccaattgttcggccagtgcatcgttggcgggcggggtggcagccgcgggtgcactttcgcgcttgccctgagctgcttgcggtggcgcaatcgccggctcgaccgtggggaattcagaagattgcgggcgtgggtcaggctcatcggtggccggcacaataccgggcgagcccggtgggtcgatcagtacagtgtattcgcgcagcaagtggccgttaggctgactgagctgcaccaggaaattcagataaggctcgttgaccggtttactcgaagtcacccggatcatctgccgattaccgcgcaggatcggcgtgaacttgaggtcgttgaggaagaacacccgctcgaccccagcctggccgaattcatcggccgtggccaggctcacggaaagatcgttttgtgtcagcccgccgacatccaccaaagcgatgtcggccttgagcggctgattaagggctgaatgaacggtgatatcacccagccccaacgccatcgaccaggtcgaatagctgaatacgccagcgaccagcaggcatttggcgccaccgcgcagtaccacgtaccgacttgcgagcatgagcatcccttaaataagcaaaaccgacttctatgcgttcgcacatccggtacgaacacgatattgcccagtagttcttatagtctgctcagcgcgatctctcaaaaaaacggcagcgggttgtgcctcaagatttttccagattacccagaatgtgcccgtgaacccgcatgcacacctttaaatccgcctcgtcgacgccctcgaacaactcgtgacgcagttgcgtggcaatcgtttcgatttgttcgatcaacggcaaggccggcgcgcagagaacgatctttttcgcccgacggtcttccattacggactggcgttgcaccaggccctggctttccaggctatcaagcaagcgtgcgagggtcggaccttcgacaccgacgctctgcgccagctctcgttgagtcggcgcctcttcgaaacgcgccagatgcagcagcactagccagcgcgcctgggacaaccccaggccggccagccggcgatccagttcggcacgccagccacgggacatctgggccagttgcatgccaaagcggtgttgatcggttaacggcataaaacactcacggttagactgaaaaataaagaatttctaattattagccagctaagcatgagctgcagttataggcaagtggcggtctgtactgaatcgttacatctcgaggccccctcaccctagccctctcccaggaggagaggggactgaatgggggatatttgggaattacgccgacgtgacagctcagcgctgaatccataatcgactcgggctttcaggtcgatgcaggacgcaagacacctcggtcggccccctctccctttgggagagggctgggcgggcggcgttccgatgagggtacggccaaattacatctcgaattccgactgcaatgcagcccgcacgcaatacagcacgccttccggcacacgtccggcaaacagctccgccacttcggcgaccgacggcaactcgccttcgccatcgaggaacgcgtcctgcacttcgcccatcagctcttcaggcaagtccagcgcctgctcgagcgacaactgctgcttgccaatcgcttcggcgagcatcgtgtagacgttcttttccgagcactgcaactgaccggcaatttgtagtggcgtcatgccggcgcgggccagtgtgatcagttcatggcgcacgtcggccaccgctttcggcgcctcgactgcgccgccaagcacttcgaggaaggcctcgccgtagcgttccagcttgcgtgcaccgacgccgctgaccgtggccatttccgccagcgaagtcggctggctgcggagcatttccagcagcgtcgagtcggggaagatgacgtacggcggcacgccgtgttcttcggcgagtttgcgccgcagcgcgcgcagcgcttcccactgttcgcgctcttcaccacgcaccagttggctggccggactcttgctgttgctcttggcggcgacttgcggcttgagatcgcggcgcagctccaggctcacttcgcccttgagcaatggccggcaactgtcgttcagacgcagaccgccgtaaccttcgtgatcgacatcagccaaccctcgcgccaccaactgacggaacaacgagcgccattcgctctcgctcaacgccttgccgacgccccacaccgacaggtgctgatggccgaaactgcggattttttcgttgtccttgcccaacagcacatcgaccagatggccgacgccataccgctggccggtacggaaaatcgccgacaacgcctgacgtgcaggctcggtggcatcccaggtctgtacgccatcgacacagttgtcgcaatggccacacggctcgggcatgtcttcatcgaagtacgccagtagcgtctgacgacggcagcgggtttcttcgcagagcgagagcatcgcgtcgagcttgtgctgctcgagacgcttgtgccgctcgtcgccctcggagttctgcagcatctgcttgagcatcaccacgtcttgcagaccgtaagccatccacgcatccgccggcaggccatcgcggccaccacgaccggtttcctggtaatacgcttcaagcgacttcggcagatcgaggtgggcgacaaaacgcacgttgggtttgtcgatgcccatgccgaacgccacggtggccaccatgatcaggccttcctcattgaggaagcgcttttggttgaaggcgcgcagatcgttgggcaaaccggcgtgatacggcagcgccgggaagccctgctcgctcaaaaacgttgcgacttcttcgactttcttgcgcgacaggcaataaacgatgcccgcgtcgctgcgccgctcggcgaggaacgccagcaactgcttgcgcggctgctccttggggacgatgcggtagaaaatgttcgggcggtcgaagctcgacagaaagcgctcggcgttctgcagatgcaagcgggtgacgatttcttcgcgggtgcgcttgtcggcggtagcggtcagggcaatgcgcggtacgtcggggaacagctcggccaactggcccagttgcaggtattccggacggaaatcgtggccccattgcgatacgcaatgcgcctcgtcgatggcgaacaaggcaatgttcaagccctgcaggaacgacagcatgcgcggctgcaccaggcgctcgggcgccagatacaacatcttcacttcgccacgcttgatccgcgcggccaggtcgcgctgctgctcggcactcagcgtggagttcaacgccgctgccgccacgcccagctcttcgagggtggcgacctggtcgtccatcaacgcaatgagcggcgacaccaccaccgccaagccttcgcgcagcagcgccgggacctgaaagcacaacgacttgccgccaccggtaggcatcaaaaccagcgcatccccgccgctggccacgcgctcaatgattgcaccctgacggccacggaaactgtcgtagccgaagatgtccttgaggacgcgttgagcctgttcgagcataaaaactccaaaaatcacaaaaacatccctgcaaggctggttcatgacgggcaaggctgcaccgcagaatcgtaagaacgcattgcatgacagctgcaatacgggcagggagcgcaaaacgcggcagtatacccgagccctcccctgcacagggcgacacccgtcgatacaatccacaatgcgcccccgtccccctgttggagctgccgcaggctgcgatcttttgatcttttaaaaaccacatcaaaagatcgcagcctgcggcagctcctacagcgatgtgggtgaatcagggcaaatctgccgttcggctggcttgagcgcgcaagaaggcctagaattcacgcattgtttattccccaaggtagccccgtaatgtccttcgctgagcaactgacccgcctgcaagtcttcctcgatgccgacgagctgcatgacgaggcgctggattacgtggccgcgcacggttatctgaccgcgctgtcgatctgcgccgaagacgtaccggagcgcgaatggatcgacgccctgttcgccgaggagccgcattacgccgatgacgcccagcgcgcagaaatcgaagccacgctgatcggcctcaaggcccacatcgcccgtcaactggcatccgatgaagaattcgaactgccatgcgaactggatctgggcgaagagccggacgactccgaactgcgcggctggtgcatcggtttcatggaaggcgtattcctgcgtgaagaagcctggttcgaaaccgctgaagatgaagtcagcgaaatgctcctgccgatcatggtcggttcgggcctgttcgacgagcagccagagttcgaagacattgccaaggacgccaacctgatggacgacatgatcgtgcagatcccagaagcactgaccgcgctgtacctgctgtgccaggcgcctgacgaaaaaccggcgatcctcaagccacgtcaccactaagatccggcctatggacaaccccataggcaaccgccccctgatgttgcgctacttgctgctggccatcggctggcttagcgtggcattgggggtgatcgggatcttcctgcccgtcctgcccaccacgcccttcctcctgctcgccgcagcctgcttcgcgcgcagctctccgcgtttctatcaatggctggtcgaacatccacgactggggccatggatccgcgattacctcgacggtaacggcattccgctcaagggcaaggtctacgcgatcgggctgatgtgggcgagcattctgttttcgtgttacctggtgcctctgccgtgggcacgggggttcatgttgacgagtgcagtgttggtgacgatctatatccttcggcagaagactttgcgcaaatcctgatgcctccaactttttaaaagacaccctgtaggagctgccgggtggccacagcttgaccattcgtcttaaacgtttgcttacctgtcagatctgacagtaggcggtgccggtcagtgcggttctaatcgatagagatcagtgcgccccccagggcatccgcctctccgacgatgggttattgctcatgagccagacaaccagcagcgccaacgcttcagaagaacaggtcgtcatctttccaccgccgtccggcgacattggcctgctctccgtaccaccgccgtatgtcatcggctacaagccgctgagcgatggtgcgctgggggtcaactacagcatggtacacagcgatcttcagggcttgctggtgtacatcctcagctatctgcagatggctgtcggtgaccatatcgatgtctatctcggcgatgcccctgcccccgtggcctcatttcctgtaaccgtcgaacatctcgatgccgacggtgtggcccgagacgtgccgttccatatctcggccagtgacatgaattccaggtatccacagccgggaaatcagccgctgtctttcactgtggagcgcatcagcggtaacgtcgaaagctcaataccctatcagctgtactataaaagttttccgccgggcaatccggacaccgacggtggcaagccattcaaccagggcctgccgctgcccatcgcctcggaaacgatcattgaccagagcgtgatcgataccggcatgaccgtgacgatcaaacgctacctgcatcaagcgctggaggatgtggtgacactcgccttcgggacattgacgttggtgttcaaagtcaccaatgcgacggcagatatcgtttttgaactgacaccggaacagctcgccacattgccaccaagcgattcgctggtggtgcgctatcagttgacagacaaagtacacaatcagagcggctggtcggatgcactaatcctgcaaagcaaaccgggaatcacattgctgccagctccggcagtcgaaaggacaccgggcaacatactcaatcatgacctgctctttggtgaaccggcgcgggtcgtgatcttcctcagcaattatgcaaagaatgaccagttgcaactgactctgcagggcctcacggaaacgggcgaagcggtcacgttcacgtacacccggtccctggacgggatgagcagcgtgatttattttgaagtcgagaatgagcgcgtgctggcgctgatccggggttccctgagactgacctacaccctcagcgcaggaggcactggcgcgccgcaactgtccaaaccgacccatatcaccattcagggcggtgcctttacccttcgcccgccaatgatcgagcaggttgtggaagacgaactgcctgccaacatcagcatggccaaagtgttcatccccgattactgggccttgaaacccggtgcgttggtgcagctgttttggcaggtcgtcgatgaactcggggtcacgcttctctttattttcgggcgcacaattactgaccccaaccagcccctgacctttgatgcaggcagccgttacatcgtacctttcgccggcaatcctctgacggtgcactacaaggtgaccaaccccgggcgtgcgccagtgcaatcaccgctgctggcactgcggatcggcaaggccagcgagccgccgctgaaacacgacctgacaaattttgaccaatacgactggaatggctggcgtcggggtccggcaacgctgccgaatgactggaccatcgtgttcgaacaaggcaactacagggcgcaaaattacacctacagcaaccactcggcgggcgttgtgttgcagaaacaattcgccaatctgaagcccggtggccggtattcgttgacggtcaactgcatccgcttccgtggcgaatatgctgcaccgtcgctgtcgctgagtgccgggggcgttgccattaccgggccggtcaccctcaatgacctggcctggacaaccttgtcaggcaacttcgtcgccaacgccagcgagatgactctggccatcgtcagccatgtcggctcaggggtcggcaacgattatcaggtggacgatctgctggtgcagctgatcgatacctgacccgttgtaggacgccccctcgaccgttcgacttaaatactcaaaaacctgtcagatatgacagtagcgagcttggcggaactggtgtgtgatgggtaatgccatattcggcagtacccgtcatgccaaggagtacatcgtggatatccagtcattggtcttgaacgaatcatttgtgctgtttcctgttttccttccaggctggatatcgccgatcaaaccgcccgagcgcgccaatggcggcgttcccagatcgctctacgatgacaaaccgacaggcctccaatgtgtcgttgacccgtggtctgagatgcaaagtcgcaaccagaccatggaggcgttcgattcggttgccctgtttataaacaacgagcttacgcaggtggacagcgccaccgttcaacccggcgacgagcaaaagcgcatcgcactgaatgtgccgcacgggcatttgaatcacggggtcaatcgcctgtattacaaggtgacccgcctcggcggtaacgtcgaaacctcgcgcgatctgttggtgctctatcacctgcgcgcgccggtcaaccttgatctgatgatcccgccagacgtggttgccaacggcgtgagtgccgaacaggcggcgcaaggggtggagttcggtttcaccttcacccccctggagccttttagcctcgtccgctttcggatcggcaatgagttgtatacccgagaggtcacttccccaccgacaccggtgaccgtgacgctgttcaccgctgacttccaaaaaatcggcgacggcaagatcgaactcgacttcgtggtgaccgaccagttgggtaactccagtacctccacggtgaagactctggacgttcacctttcccgcccgctcgaactacccgccccgaccgtacgcggccagaccggcaacaacttcagtccgacccagccggagattcgcgtgctggtgccacagggttcgctgctgcctgacgacaagctgaccgtgcaatggacaggcgccaccgccgtgccagcgggttcctacaccagcccgcaacggctggtcagcgccgggctggaaatcgcggtgccacgttcggtactcgcctacagcctgggcaaacccgtcaccgtgacttacaccattgagcgcaatggcgtctccaccacatcactgccattgacgctgaacattcaaaccttgccggccagtgctctgatcacgcccaagatcatcgacgccgatgccaacaacgttctggatgtgatcgcgctcggcaccaaaaacccaacaattcatggtctgctctggacgttgatcgacgtaggccagcacgtctggatgagcctggaaggcaaaaaggccgatggcagcccccataacctgacggtgtggagcggcggcgcgagttacgccaatgcgacgtgggtcagccagggtttctggcctcgcacttttgccaatagttacgtgaaagaactgggcaacgactcgacgctgacgatcaaattcaaggcttcgctggacaagagtaacaacgcggctacggccacggtgtttccggatcgcacttacaccatcagagccgtggcactggtcgcaccgaccatcactcaagccctggactccaaaggggtggcgattcctcagggcggtacgaccgtcgacaccacagtcaaactttcaggagccgggacgtcgttccctacgacctgccggcaaacaaaacccgcagcaccttcaaaaccctgagttcaccgggcggcaagggctacaacgaattccggattgaagacaagaaaggtgtagagcagatctacatccacgcccagcgcgattgggacgagaacatcgagcacgaccagaagattcgcgtcggcaatgagcggcatgacaccgttgaagccaatacgctgagcgagttcaaggttgaagagcatcggataacccatctggatcgaatcagcgaaatgcgtgcggatgatcacttgaccgtgggtgtgacgcagcatctgaaggtggggactgcgcagtttgtcgaggctgggtcagcaatccattactacgccggccagaaggttgtggtcgaaggcgcaatggaactcacggccaaggctggcgggagttttgtgaaggtggatgccggtggcgtgaccatcagcggcgcggaggtgaagatcaataccggcggctcgcctgggattgggacgcctgcggcaccgctgttgccgggaccgatgaaggtagcggatgcggataaggccggtacggtccctatcccgctgcccaaacgcttgaacgagtcgggtattacgccgttgtgcggtaaacaaagcaacggcgcctgcagccgtaaggattgcacatgcatgtaaaagcgctgagcgccctcctcgaagcgccacgccatgggttcgaggaattgccgagagaaagctccgacctgaccctgtgtttcatcattgatcgcgtccgtcagccggaagccatgagccgcctgtaccgtgtcggcgagcccgtagacacccaaggtctgtttctcaacaccgacttcgctgaaattgccgctgacggtcctctctggctggtcgccccgtggggcagtcgactcgcagccgaagcggcaaagctctgcgaagaaaatttctccggcattgccctctccacaacagatccagccaaggcactggcacatgcccgctggctcctgcgtgccaacgatggctccggtggccaaagcctgttgagctatcacaagccaagcctgtgggccgcgctggcctacaccgctggtgaagcttcgcatcagcttttcggcccttggcaacacgtttacagcccggcaccggtccacttcgggcgtaatcgcggtcgctggctcagctggcgccccgtttcggaacttgaatggctgggcgacgtctcagcgttcaacctgccgccaacagcgccaaaggttcaggagcatctgggttgggtttattgggcagacgagcaatacgctgcctacggtgaacccaccgacgaacaactgcccaacctcgtggaaaacctgaacgtgctggttgcccacaacatttacgaaggtcgccatttactgaaactgggccaaatcaccaacggcccactgctcgaaacgcagccacaggcaatggccatcctgcaatccagggaagagtcgttcatcaaagtgcagcagttgcagcaactcgctatcagcgctgcttgatgacccccgtccgtaaagaatgaatggaagcgaaatggaacagaacaccagcgcagcaactaacaccgagtcggcacctgctacaccagtagttgcagacgggacttgtgcaaaaccacctcgggatatcggtgaacaacccgaagcgccggaagatacaccaggcgatcacgacaaagtgaaaacgccctgctccaccgtttatggcagcgccatttacgacactgagaatgaatcattctggttgctgccggagcgaaccaactcggcactgaaagaagcttccagcgatctggaacaaaaagtcagctctaccaagtcacccgaagagcgcaaaaaagggctctacgaatccggtctcttggagtatttcctcgaacccaagctggcaaactttcttgagggtgaagagaaatcccggatgctggagatcgaaactcaacatcccaacataagtaatctggacgcggcgctgcttgaatcgcaacagagcaggaaagccgcagcaccagaagcagaagcagaagcacctgcaacgcctctcacgcgcctcgaacaggatcagatcaaaagaaacgaattgatctccgcccgtgacgacgctactcgcgtgcacggcatgcacagtgaatggaaaaagctcaagcgtacggccattgccgccgcgacggaaaaaggctacgcgtacgaaagcggcagtctttatgcgccgaaagccatagccgctcgtgaagccgttcaaaaatatctgaaagcacgagaagcgctgttagaagacaaggatctaaccacgttaacatcggcagaactcgccccgatgctcgctcaggacaaaaagcggatagatgacatcgcgatgtgcggcaccaataatcagttgatgctgtgtacttatgtgcgtgaccaggaaatcaaacgcaaggaaaggaaagcgacttataacgcttatctggatgccatcaccgatgttgctcagtacggaattgccttgcccgagttcgcactgatccccgaagggggagcagtcgagggtggcgtcgacttgttcaagcagtatctggcactagagaaagagcaaaaagaggtcaatgaacgcctcagtaccaaatacaaaagctggatcgaggcaagtggacgacaagccaaggcgcccaccaaccttgtcaccaatgagcgcaccgcctgggatcggctgcaagcatcaaaagaaacactacggctccaagctgaaaacaatgtggaaacggcgactgttcgccgtcatctgttgtgggagccagaacaatttcaggcaagacctgaagagcgtttgatcaagaacggtttcccgctggccgagatgagcatggcggacagtctcaacaaaccgctcacctatctcagcatgtattcgcttccacgactcaaacagaccgttaaggatgattggaagaaagttggcgccaaggtcaaagatctggcgaagcgtccgggcaatagtgatggaaaagcaacgaccgacactgagctgagcttgttcggacagtggctgaaagacgaaggcgctttgaggatcaaggatcaggaaagcgattggttctcctccgaaggctggttcgagatcgaaaaattcaacgcctatcttgaaagcaaaaagtacaaggttacggcgctggagagcgctggaacgcgtaaagaatggggagaccggttgcagcaagtgttgttcaaggacaacgttcgcaagaccttccgcattttcgacatcactccgcaggcacagttggttcgttgcctgatgccttccaccacgaagatcatccattcgtcgacaaaagtagaggggcctgattggacattggccgaaggattccaggcctcggcgaaggcgacctttgccgttgaccttgccaggggtgaagtcgaactcttcaaagtcgacttgccagaccgcgccagcgctaaagatatcgttatcacctaccgaaacgccgaagacatacagcagaagatgaacctcggacgtttttcgctctatctaggcgcgaaggcttggggctacgccggagcatcgttgctgctttcttcggaaattgcattggatgtcagcaacgctggcttccatttagcgcctccggaaccagtcgttcgcaaccccgataagcgcagctacgcgagaactgaaaaaagtggccaaattaaaagagctcctgaaacgctacagatacaggatggcgcaaaagccgcattcaatctgttcgcaggtctgcaaaccgggatcatggtcaccggagcgctaaactgggctcccccctccgaagtagccttgctaaccaaagcgcccgttgccggcaaagctgccggaatgaaggccagcgaatggtttagccttgcgcgtttgaccgtggaactcaatgccgcagccggtctcggtgcgagggctgaagcgagtatttccctgcacgagggccgtctgattctggtgctcaaggccgcattgattgccggccccggcgtaggaggttccttcaagttcgaggtgggctacgacgccgtcaccgagttactgaacatgttccgtagagaactctataaaaacaaacagaacccgtactttgttattgaaaatgaaacctacgcatacctttcgaaattaaatactctggccattggtggctttgatatccgcatgatttatctcataggcgctgatgcagtgatggcgctttatgaaagtttgactgcaacgggtaagggcggtgcgatagcacaaaccattatgtcttatgagaatcaactcgaactagaggaatggtgcataaatgctattcccggagcattaggtcctctccttctaactctgatcagccctccaagtgatttttctgtaacaatctccagacccacagggaaaacagcagaaaaagacgacacgattaaatacagcgaccaagaatcacatttactgcaacagcaagccattgagaagattttgtcttggatcctgaagcgtgcacagaaagacaacaccattgataaagcacaaagtcagtttgaagacatatgcatgtcgatgaacaaattcggaataaaaccagcgaacgcaggacagttgtattgcgagagcaggcttgcacttgacaacttcatggcagagcctgtactccgcctaacaaatcgttccggtgatgatatgcgcgccgattacctagctcacgtacaggtgctaggtgcgaaaaaagatggacaatgccaaagatcccagtattttggtagaacttacatgccgtctgggacagccaaatttatagccccaacgggtaatatttgagaaaaaaaacatgcgcctcatagtattattttcagccacactactactcatcggcgccaaccaagcaagcgccgaactgaatgctgagcagttgcacgcaaagcaacaaggaataattctttacaatcaattcaaagccgtttctgcaactccactactgagaatagcggcagaggctggagaccatgaggcacaatattatctagctgagtcgttgcgacaaaaaaatagctatatgaatcctgaagctaaaaagtggtatgaaaaggcagctacccaaggggatctttatgcaatgatccagcttggacgagtaaaaaatgatttgtgtaaattatcagaagattgccccgccacagaaaagaagccatcagactggttgaatcaagcatctagtatcgctcagcctaaagctgaagatggaaatgcagaagccatgtacataatgtatgaattaacacttgataaaaattggctagaaaaagcagctgcaaaaaatcaccaaatttcacagtatttgttagctaaaagctaccatcagggggacggttttttccttccatggaaacgctcagaagttgtcgaaaaactattcaaagcttcagctgagggtgggtacccgccttccatgatggaatacggagcccttctttatgaaaaaggtgatattgaagggttccgtcaatggaatgagcaagcagctttagcaagttacgccacaacggtttatggttacggctctgatcttgctcatgagccagacacgtatggatttccattcgatgtcgttaaaggttatgcgctcgtttacaccttgaaggagttagacggcggtgggggtttacaagaaagagtggagagcaagctaccaaaaattgaagcgaagatgacagctgaacaagtttcagaaggcaaaaaacttgcgaaagaatggaaggctactcacgccccactttccttctacccagacaaattaagtcgctaaaaactaaatttatcattaccctctttctgacaagttaagctgatagaacccatgaagtatttggccatttttatgctactcatgacatcacttccttcttacggggaagcccaactggatgcacagcagaaaatcgctaaaaacaaaggcattgcactttacaaccagtacaaggccatttcagccatctcctttttaacaattgctgcagaggctggcgatcctgaagctcagtattatttaggcgaagctcttcgaacaaaaaatcactatatgaacgcaattgccagaaaatggtacgaagtgtctgcgaaccaaaacaacctatatgcaatgattcagttaggacgtatagagcaagatctatgcaacatatcaagtgactgcccccttcgcaaaaaacacctacagagtggttaaatcaagcaaaacagttagcccgacaacgagctgacgcgggtgacgcagaagcgatgtacctgatgtacgaaataacgctagatgatacctggttagaaaagtctgcttcttcaggaaatgctattgcgcaatactggttggcaacttcattgaaacaaggtgagggttttttgcttccatggaggcgaagtgaggcgattgaaaaatggtacaactttcggctgaaggcggcaatcctaaatcaatgatggagttggcggttcttctttttgagaaggggaatattgaaggcttccggcattggaatgaacaagcagcagttacgggttatgcagagtccatatatggatacggttcatacttggctcacgagcctgacacctatggctttccttatgagcctgtacagggatactcgctcattcactccctaagcatcttggatggtggtggaggaatgcaggaaaacgttaaatacaagcttccgcttattgcttccaagctaaccccttcgcagatattagaagccaaggaacaatcaaaaaaatggatatcaacgcatccacccctgtcttttttccctgacaagctaagccgttagattattttactcaaaaacagtggcgcaagaatcatacaaacgggaggagtagatagctcggagtttgccccaacgccgtcctactcccgttttcactagcccatcaaaccggcgccttccaactcaacatctgctgctgcgcgacctgcagcaaatcattgccatcctgcgtcagcaggtacagcgcatgggtgatgtgtggaatgtcctgcacgtcggcgtgcttgaagcacaggcaatgcaaggtttcgagtagatcggcggcggcgcggatgcgctggacggcggcttcgaggatgtctttcgggttggcttgggtgtcgatgagcagtgtcggggtttcggtgacgttgctgctgagggggagatagcggttttgtagcagtttgattattggcatattgattactcgattgtttcaaaagtaaccgccgacaccgtgaccaaacgatgggaggcggaccgtgtacaggcttggtcaaccgagaacaatcaactcagctcgcccgaaggcgtcctgcacacggccgccacagctatgcacttcacggtcaaagaactccgcggagcagatgatggcacatatgcaatcgattattcccgggtgaccaaacccgaaccactgattttgcagcggcaaccgacaataaccgccccgctccagccgccgaaagcagacaaggcaccagcctttgtaggaattcgccaaacatcccgaagaaaaccaccccactccctgacagccggcattcagcttggttaaccatcccttaacgccgcggtcaaaaactctactgaaccgcacgccctcaaccattctggctgttgcccagtgcggcaggttcgggtgagtcacgccgaactctagaaccgccacacgggagtcctttcatgaacattcgtcctttattgctcaccgccgccctcgcctgcactgcgttcgccgggctggcccaggccaatgacacctctgccacatccaaagccgtgccgtatgagtacggcatgccgctgcaggtggccaaggtggtgtcgttgaccgagccaccaacgcaactgtgcaaagtggtcacggccgatatgaagtacatcgacaatgccggtaagcctgaggaaatcagctaccggaaattgtctgacgcgtgcaacttccagaactgacagaaacgtctgatttgcgggtttgcggtaggcgtggggagtttcggcggttatgctcggagccctcctcactgccgcaaggattcgccatgcagttgtcgtttcgcacgttgtcgggcttcacgtgttcgttgtgtttcttgctggcgttggcttggggcgttttcccggagaggctgctggcgatctggagcatcgagtattccgacgctgccgggtttgtcgcgcggcgcagtgcggtgctgtttgcggcgttgggggtgatgttttatctggtgcgcaatgcaccgccgtcgctggggcgcaatgcgctgagcaacgggtttatcgtcggttgttttggtttggcggtgttggggtttgcggaatggttgaacggtcatgccggccccgggattttgctcgcggtgctggtcgagttcgcgctgggccttggttttgtgcaggcccggcgcgtgacggtcgaactgggtgaaacggtgcgttaaacgactctggagcgtggactgtagtgatgttgcacagtttgctgattcagatccgagcgcagcccggcgatcaattcgttgatttcacgacagccattgagattgctggcgtcgatgccactgaccagcagatcgacctgatcggtctggtgatcgccgaaaaccttgacggtcatcgacaagtccggcgacagcgtgcactggcagcgtttcggcagaaaactgctttcaatgatattgcgtagttccaaggcagacagaaacatggcgaaaccctctccttactgtgagatgccaatcaagtattcacgctgaccgttgctgcccctgcacgggtgtgtccccgctgtttccctggtgcgacaagcggtggtactgcgaaatgcccattggagtgtaggcgcccaaggccggtgcgccgcactgaaaagacgcataaagcgtgcctttcatcggttcattttcaccctcatgaaatcaagcacttggcggcggtgccagtatttggctacttgcaaattgcaagaatggcctcggcgggtactgcaatttgcaactcgacgctggtttgcaatcacggcccatgacggtaagaatgctggttatccaccctacacccgcacggaggcttccatgggttctttccgcgtttacgcgaccaccgggctgttcatcgccagcctgtccaccctcgcccacgccgccaaacttgaagacgtcgcgccgtacccgaaggcagaagccgggttcacccgccaggtcattcacttgcccaagcaagaacaggaagacaacttccaggtggaaattctcgccggcaaaacgttggaagtggactgcaaccgccagcgtttgggcggcgttctcgatgagaagaatcttgagggttggggctatccgttctatcgactggaaaaagtcatcggcccgatgagcacgatgatggcctgcccgcccggcagtcagaagaaacgcgcgttcgtgccggtcgtcggtgacggtttcatgctgcgttacaacagcaagttgccggtcgtggtgtatgcgccgtcggatgtcgaagtgcgatatcgcatctggtcggcgtcggacaaagtcggtacagccctgcaggaataacccgagcaaggagtgcgtcgtttgattacctgccacgtccgatatgtcattgatccctaccaattgcctgagttcgaggcctacgccaaggcctggctcggcatcgtcgagcgcttgggcggcacgcatcacggctattttctgccgtccgagggcgcgagcaacatcgcttattgcctgttcagttttccgtcactggcggattacgagagctatcggcacatcgcgatgaccgatccggaaagcaccgcactggtagccagcctggtcgagaagaagttcatcgtcagctatgagcgcagcttcctgcgcccgttgctgccgtaaacctctcacgccgagacgctgcagactgcggcgcgctcggcgacatggcgcaggctgtcgaagttgatattagcccccgagtcgatcgccacgaatgtctgctcgcgcaccccggttcgcgctacgtattgcttgatcccggcaacggccaaggcgccggaaggttcggtgatcgagcgagtatcgtcgtagatattcttgatcgccgcgcagaggtcgtcgttgctgacggtgatcacttcgtcgacgcagaagcggcaaacctcaaacccgaacgcgccaatctgcgctaccgccacgccatcggcgaaagtgccgacattgggcagcacgacgcgctgatcggcttcgagcgcggccttcaggcacgctgagtgttcggattcgacgccgatgatccgcacttccggcctcaggtatttgatgtacgccgcgatgccggcgatcaagccgccaccgcctaccgggatgaagatcgcgtccagcgcgccctggtgctgacggaggatttccatggccaccgtgccctgtccggcgatgacatccgggtcatcaaacggtgacacgaaggtgcgtccggtttgttccgccagttgcagcgcatgggccagcgcgaacgggaaactctcgccgtggagtaacgcttcagcgccgcgactgcgcacacccagcactttcagttccggcgttgtcgctggcatgacgatggtcgccgcaatcccgagttcgcgcgctgccaacgccacgccttgcgcgtgattgccggccgaggcggtgatcactccgcgcgccttctgttcttcactgagttgcaccagtttgttgtaggcaccgcgtatcttgaaggagaacgtcggttgcaggtcttcacgcttgagcagaatccggttgcccaacgcctccgacagcgccggcgccgcttgcaaaggcgtgcgcaccgcgaggtcgtacaccggcgcagcaaggatctttttcacgtagtgctcaagcagggtttgctgatcgtatgtgtaactcatgaacatctccttggcagaatttcacacggtccctgtaggagctgcccgagccttcggcagctcctacatgagccacatttcaaaaaccctggagacagaaagtaaaaacccgcctctagggcgggttgggtgctgcagtcgtgagctagcccgccaaatgaggaatggcggtaataataattggctggcaacgcgatacagtcgaagtcatgggctggaaattagcctgcgaggtgctggcaagtcaatggccaatttttgccggcggcgttagtctggcgactctctcatcacaccaaggaaggattgcatgatgtctgtcgccctgcccctcaccgctttgctcgcgtttaccggctacaccgtttcggtgatgcttcaggctgaacaatcgttgatcgacttcggcatcagcctgatgtcgcgcccggataccgcgcaagtggtgattgatttgtacctgctggcgacgttggccggggtatggatggtcaaggatgcacggtctcgcgggcagacgatttggtcggtgctgccttatttgttgctgacggcggtttttgtctcgattgggccgttgttgtatctggtggtgcgcgcgatacgggagcgacgtaaagggctggatgtggtgcaagcgcgctgattaggagcatttggcgctacggatattgctatcgcgagcaggctcactcctacaggtgattgcattccaaatgtaggagtgagcctgctcgcgatagggcattctgagtcagcacataatcatctggccagccgccgcaggccgaacaacatcccgcccgcccccagcagcatcaccgtcagaaacagcggatacgacacccaccaaggcgtcccggccgtcatcatgctgaattccgacatgccgccgatactcgcaatcaggttcaacggcaaaaacaccacgttgatcaacgtcagcttgcgcaacaggttgttcatgctgttgttcatcagattgccgcgcgcatcaatcagcccggaaaacaccgtcgaatagatttcggcctgcttgtagcactggttgttctcgatgatcaggtcgtcaatcaggccgatcgcttcgctgctgaagtgctgtttctcggcatgattgcgcaaccgcgtcagtactgcgccattgctgtgcagggcgttgatgtaatagatcaggctttcgctgaggttgaacatctgcaccagatgctggttttgcattgaggcattgaatttttgctgcaactcgcgagcgaccagtttgatcaccttcaagtggccaaggtagtgatgaatgttgttgaacagcacatccagcaacacatccagtggcgcgtttaaccgctgacgggtgccgaggccgtgcagtggcgtgtcatcggtggcaatcaccagcaactggcccggcgagaacagcaggccgcaggacgaaacctcaaaggcgaggctgcctcccccggaatatttttccggacgtttccagatcaggaacagatgatccgggtgaaactcgatgcgcgacacttcgtccgggtccagcgccgaggccagtgcgtgctcatcgaccttgaactgactgtgaagcagatcgcgctccgccgcgtcgggattgctgaacagcatcacttcggcgttcagtcgctcaacccgctgcaacgcgccgtggctcagtgcaaaactgttgatcatcggtagatcaccaggcctggccgcgacgtttcagctccagccggcgcacgaactcttccagcaccaggcaatacaaatcgtcctgcaggtaagcatcttcgatgccggcgtcgaggtttggattgtcgttgacctcgatcaccacgactttatcgccagcctgtttcaggtcgacgccgtagagtccatcgccgatcagattggcagtctttaccgccagttcgaccactgcgcgtggcgcttcatggatcgccaaggtgcgacattcaccgttgatgtcctgtcccttggctttgtggttgtagatctgccagtggcccttggacatgaagtactggcaggcaaagatcggcttgcggttgagtacgccaatacgccagtcgtactcggtgtagaaaaactcctgagccagcaacagcaccgagtgctcgaacagttcggcggtggcttcaagcagcgcctgctggctctcgaccttgatcactccacgcgaaaaacagccgtcagggatcttcagaaccagcggaaagcccagacgttcgccgacacgctcaaagtcctcgggtcgctccttgtagagaatttcggtggcgggcatgcccaactgatggctgttgagcagatcggtcagatagaccttgttggtacagcgcaggatcgacgccggatcgtccatcaccaccagcccctcgctttcagccttttttgcaaaacggtaggtatggttgtcgacactggtggtttcacggatcagcaaaccgtcgtactcggccagacgcgcataatccttgcgttcgatcagttcgacatcgatacccatgcccttgccgacccgcacgaagttttccagtgctttgcggttggaaggaggtaaggcctcttgtggatcatgcaggatcgccaagtcataacgggcgacatgtcgcgagcgtggcacgcgccagactttacgactgaagctgtccagcgcattggcgaattgatcctcctgatcatcacgcaacttgtgcaagacacccgactttataccctctatgtgccaaccgttgtgccggcgaaattcaactagcagaatcggacagggaaacacttcaaacaactgacgagccaaatcctgcaatggttcgatatgggtacggccgaaataaagtgtcagggtaaagccttcggtatcgctatacagatgatgactcagcgctttttcgagcgttttatccagatcatccaaagccagtccgtagagtgattttttagtcagctcactgatcgtacgtaccgatggaatgaccttgtggccacgggcctcagccaagagcgagcagtagtagccatgacccagatacttgtagctgcggcacagattgatcacctgaacgcgcttgcccgcctcgccttcacgcgtttgttcaaggtactcctgcgccgtaatgatgtcttcgctggggaagtacgaagcccagtcttccttgcgttcgacaatgatcagcaattggctgggagttctaacaactgaatttaaaaaagttgccgacggcaaactttgctctgatacttcgcgccaatgaccctgtaccgctgacatagagattgatccgttggagaacaagaccatttctattaagcacgaagtttttcgaaagtcccgtttcgttacgcaacttttacggtggtcatatgagtgcgatttttcgtttggcggtagttgaagatttgccggcgttgctggcattggaaatgcaatgcttcactaccgatcggctcaccagtcgcagcttccagtggatgatcacccgggctaacgggcagttgctggtggcagaatccagcggccagttgctgggttacgcactggtgttgtttcatcgcggcacatcactggcgcggttgtactcgattgccattgccgccgagtcgcgcggcagcggattgggcaaacaactgttgcaacggatcgaggccgttgcccttgagcatgattgcgcctacctgaggctggaagtacgcactgacaacccggccgcgattgccctgtacgagcgcaacggctaccggcgcttcgcggtgattcacgattactacgaggaccatgccgatgcactgcgcctggaaaaacgcatcctcgagcatcgcgactcgcgcagcatcaaagtgccctactacccgcaaaccaccgaattcacctgcggcccggcctgcctgctgatggccatgggcgcattgcaggctcagcgtttactggaacgtcgtgaggaactgcagatctggcgggaagcgaccacggtgttcatgacttccggccatggcggatgcagtccgcaagggctggcgctggcggcttggcgacgggggtttcgagtacgcctgcaggtgagtctgaccggggcgttgtttcttgatggtgtacgcgatgcgcataaaaaagacgtcatgcgcttggtgcacgaggagttcatggcgcaattggcggagtgcgacgtcgagcaagtgatcggtgttgctctggacctcccgcggttactcgccgctgggggacagccgctggtgttgatcagcagctatcggttgactcgttccaagtccccgcactgggtgatggtcaccgactgtgatgaggactttgtttatctgcatgatccggatgtcgatcacagccagcatcgccagccgatggactgccagcacgtgcctgtcagtcatgaagagttcgaaaaaatgtgccgatttggccgaggcaagttgcgtgcggcagtcgtcctgttctcccgcgaaacataagccccatccgtatctgtaggagctgccgagtgcaacgaggctgcgatcttttgatcttgttttttaaaattaaaagatcgcagcctcgttacactcgacagctcctacaggggggatggcggtcaaaggctgggtttgaggcccagtttgtacagggcgccgttcgactcatccgtgagcacgtacaggtagccgtccggcccttgtcgtacgtcgcggatgcgttgtttgagttcgccgagcaagcgctcctcgtgcacaaccttctcgccctcgaattgcaaacggatcagctcctgcgtcaccagcgcgccgataaacgcattgtgttgccaaggcttgaagcggtcgccgtcatagaaggccataccgctgacgcccggcgacttttcccagacatgatgtggcgcaattgtgccttcggcggtcttgccttgtgcctcggggataggctgcatggaatagttgatgccatgggtcgccagcggccagccgtagttcttgccccgctcgatgatgtttacctcgtcgccaccgcgcgggccgtgttcattttcccaaagcgtgccggtccatggattgagcgctgcgccttgcgggttgcgttggccgtaagaccatatctccggacgaacgccggactggccgacaaaggggttatcgtccggtaccctgccgtcggggtagatacgcacgactttgccttgcagcttgtcgagatcctgtgcggtgggccggtcgttgttttcgccgagcgtgatgaacaggtatccgtcacgatcaaacaccaagcgcgaaccaaagtgattgcccaccgaaagtttcggttcctggcggaagatcactttgaaatccttgagcgacttcaggtcatccgacagccgcccgcgccccaccgccgttccggctttgtcgccggcaccgccaccttcggcgtaagacagatacaccagccgatcctgtttgaagtccggcgacagcaccacatcgagcaaaccaccctggcccttggcccagacttgcggtacaccgctgatcggtgctgacagcttgccatcgacacccaccacccgcaggttgcccgggcgctcagtcaccagcatgccttggcgatccggcagaaacgccaaggcccatggatgttcaagaccttgggtaatcgtggtgacttcaagagtgccctgttcgctttgcaattctttgggcgctgcggcaaacgctggagcactgatcagtgcgccgacgcaaaggctggctagaagggttttacgcaacatgcacgattccttttgttcgtctcaaggctgacaggcttcagtcctgtcgtttaacgggtagtaccggtgcttcgtgaaggtggattggggatgaaggttggcggtgtactcggcaccgagcggattggctgaccattgccgataccacggttttcgagggtcggcgggcgcggcaccggcacggtattggggccacggatcggcggtgcactgggttgagtgccctgcatgctgttggggttggcccggcggatcggactgttgtagggattgttgctgttgccggtcggactttgtgccagcagcagcgtggtggatggcacgtccgcatgagcccagcccgcaccgaggctgaggaaagcgatgacaaacagaaatcggttcatggggcggcctctcgatgcgccaaggatagtgccttcgagtccacgctacgcccagggttcggatttgttaagtcacagcctttaaacaacatgtaacacggcttgaccaagtcagcggcggccgccgcaatcactggaaactttcgcccagcgcaacaggtcacctgatcatcactcggagaactcaccatggctcgggcaatctggaaaggcgcgatcagtttcggactggtacacatccccgtcgcgctggtctcggcgacctcgtcgcaaggcgtcgatttcgactggctcgacagtcgcagcatggatccagtgggctataaacgcgtaaacaaagtgaccggcaaagaagtcaccaaagagcacattgtcaaaggcgtggcctacgaaaagggtcgctatgtggtgcttagcgaagaagaaatccgttcagcgcacccggtctcaacgcaaaccattgatatcttttcctttgtcgatgccgagcaaatccccctgcaaaacatcgacacaccttattacttggcacccgacaagcgcggcggcaaggtgtatgcgctgctgcgtgagacgctgagcaaaaccaacaaggttgccctcgcccgtgtggttttacatacccgccagtatctggcggcgttgatgccgctggaatcggcgctggtgctggtaaagctgcgctggccgcaggaggttcgcagcctcgatgaactggcgctgggcagtgaggtgaccaagccacaactggcaaaaggtgagctggacatggccaagcgactcgtgcaggacatgagcgcagactggaaacccgaggattacaaggacgagtttgaagacaagatcatggccctcgtcgagaaaaaggcccatgaaggcaagatcgaagatgtcgagacggtgggtggcgaggaagagcgcaagtctgcggatgtgattgatttgaccgaactgctcaagcgcagtctgggcgggaaagcggcgccgaagccaaaagccaaggcagcgccggcgaagaaaacgaagaaagcgtcaggcaactgacaggttgtttttgcgagagtcgtagcactccgacgcgacgcaggtccaatgtaggagctgcggcacgctgcgatcttttgcctttgatctcacttcagcagggtaaaaagatcgcagcctcgttgcactcgacagctgctacagcgacctgtgagtcaaaggattcgtcagatcaggatgaagatcgccagcaaaccaccgaagatcgcccatttttccatgtaatacagcttgcgattacgctttttcaattctttgccgcgcaagcgaatcttgtagatcctggcaaacaaacggttgatcccaccggttttatcaccggcgtcgtttggcgcacccgccgccgacatcacggtgcgactgaaccaactgttgaacgccgccgcccagcggtatttcatcggacgttcgatgtcacagaacaggatgatccggttctggtcggtggtgttttctgcgtaatgaataaaagtctcgtcgaacatcaccgcttcgccgtcgcgccagtgatagttctcaccgtcgacgttgatgtagcaaccggcgtcgtttggcgtttccaggcccaggtgataacggtaggagcctgcatacggatcacgatggcgtaccagtttcgagccgggtggcagctcggcaaacatcgctgccttgatcgaaccgatgctctgcaccagttcagtggtgcgcgggcacagtttcattgccgatggatggctttcgccataccacttcagataaaaacgcttccagccggatttgaagaacgagttgaagccgacgtcatcgtattggttagaacgcttgatctccccagcgcgcagcaaattctgaccttcttcgcgaatctcctgccaatgcgcctgcaaggggcttagatcaggaaactccgacggatcgagaaaaggcttgttgggctttttcgagaacaggtacaggaagcaattgatcggcgccagaaacgtcgagtgatcgctgagctggcgacccagcttgtggcgcacacggccacgaagatgaacgtatgcaatcgaaatgacataaatagcagcaatgatgagtttcacggaaatcgtcacacgtcagaagtgaacaaactgcgcgcctgacggcctgaggcccagcgtctgatgcagtggtctgaatacaaatggcacatccatgagcccgcgccgtgatggggcgctgggtgaatggatggcattttagccacactttgtaaccgatagtgaaccttcatctgtgaaaatctgtctcgcgagcatgccaatcggcgatcttgacgtgatcgccctatcgtttaaagagccagaccagtacaatcgccgccaaactttacgcgccccccttggttgatgacgggtctttcccgcttcagcgcactttgactcgggccaagcgctccagccgcaccctcgctactcgaatgcttcgcaggaaaaactcttgatttctacagctaacatcacgatgcagttcggcgccaagccgctcttcgaaaacgtttcggtcaaattcggcgcgggcaaccgctacggcctgatcggcgccaacggttgcggcaagtcgaccttcatgaaaatcctcggcggtgaccttgatccgaccggcggccaagtcatgctcgagccgaacgtgcgtctgggtaaactgcgccaggaccagttcgcctacgaagaattcaccgtgatcgataccgtgatcatgggtcacgaagagctgtggaaggtcaaggccgagcgcgaccgcatctactcgctgccggaaatgagcgaagaagacggcatggccgtggccgagctggaaaccgaatttgccgaaatggacggttacaccgccgaatcccgtgccggtgagctgttgctgggtctgggtatcggcatcgaacaacacttcggcccgatgagcgaagtgtcacctggctggaaactgcgcgttttgctggcgcaggcactgttttccgacccggaagtgctgttgctcgacgaaccgaccaaccacctggatatcaataccattcgctggctggagaacgtcctgacccagcgtagcagtctgatgatcatcatctctcacgaccgtcacttcctgaacagcgtgtgcacgcacatggctgacctggattacggcgagctgcgcctgttcccgggcaactacgacgagtacatgaccgtggcgacccagtcccgcgagcaactgctgtcggacaacgccaagaagaaagcacagatttccgagctgcaatcgttcgtcagccgcttctcggccaacgcctcgaaagccaagcaggccacttcccgcgccaaggcgatcgacaagatccaactggccgaggtcaagccttcgagccgtgtcagcccgttcatccgtttcgatcagaacaagaagctgcaccgtcaggctgtcatggtcgagaagatggccaaaggtttcgacggcaagccgctgttcaaggacttcagcttccaggttgaagctggcgagcgcgtagcgatcatcggtccgaacggtatcggtaaaaccaccctgctgcgcaccctggttaacgaactgaccccggacgccggcagcatcaagtggaccgatgccgccgagttgggctactacgcccaggatcacgctcacgacttcgaagacgacgtcactctgttcgactggatgggtcaatggactcagggcgagcagatgattcgcggcactttgggccgcatgctgttctccaacgacgagatcctcaagtcggtcaaagtgatttccggtggtgagcaaggtcgcatgctgttcggcaagctgatcctgcaaaagccgaacgtgctgatcatggacgaaccgaccaaccacttggacatggaatcgatcgaggcgctgaacctggcgctggaaaactacccgggcacgctgatcttcgtcagccacgaccgtgagttcgtatcgtccctggccacgcgcatcatcgagctgaccccggatggcgtgactgacttcagcggcacgtacgatgactacctgcgtagtcagggtgttgtgttctaaacagcagcttctagtgttgcgctgttagctccaagctaaagccctgtccatgtgacggggctttttgcattcagggtgctgatcgttcccacgctctgcgtgggaatgcatcccgtgacgctccgcgtcacacgagcgggacgcggagcgtccgtggcggcgttaccacgcagagcgtgggaacgatcggcgggatggaaagtagttagcctgctttcttttatcgcaagcccacgccatgatgctcgaactctcccaccgccgcccgcgaacgagttctcatgtctgcgcagcaacagccaccgcaaagctccatggcgatcaccctgcagatcgtctccatcgttttctatacctttattgcgtttctctgcatcggtttgccgatcgcagtgttgcccggttatgtgcacgagcaattgggtttcagcgcggtcattgccgggctggtgattggctcgcaatacctggccaccctgctcagccggccaatggccgggcgcatgtcggatacggtcggcactaagcgggcgatcatttatggcttgtgggggattgtcctcagcggcttgctgaccttggtctctacgctgctgcaagactttccgctgaccagcctgatcattttgattatcgggcgcttgctgctcggcatcgcgcaagggctgattggcgtcggcacgatcagttggtgcatgggccaggtcggcgtcgagcacaccgcaaaatccattggctggaacggcatcgcttcctatggcgcgattgccattggggcgccgctgggtgtggtaatggtcgccgattacggtttcaccagcctcggcatcgcgctggcggtcctcgcggccggcgcactgctgctgatccgcaataaaccgtcggtgccggtgatccgtggcgaacggctgccattctgggcggtgttcggacggattgccccgtatggcgccagcctgaccctcgcctcaatcggctacggcacgctgaccaccttcatcacgctttattacctcaaccgtggctggaccggtgcggcgtactgcctgacggtgtttggcgtgtgcttcatcctgtcacggctgatgtttatctcggcgatcagtcgcttcggtggcttcaggtcagccattgcatgtatgactatagaaaccgtggggctggtgctgttgtggctggcgccgtccaccgcttttgccttgatcggcgcggggctggccgggtttggcttgtcgctggtgtatccagctttgggtgtagaagcgatcaagcaagtgcccagctccagccgtggttccgggctgggcgcttacgcggtgttcttcgatctggcgctggcgattgccgggccgttgatgggcgcggtggcgttgaatcttgggtatgcgtggattttcttcagtgcagcgttgttgtcggtgattgggttggggctgaccctgctgctgatgcgtcgcgcgaaggattgaaaaacacgatcaaaagatcgcagccttcggcagctcctacatgggaatggcgtacatcctgcaggagctgccgaaggctgcgatcttttgatctattgatccgccgtttgcatacccgcacgcgttgattggcccagcgcatgggagaaaaaccgtccggcctcggagatcagattacggtgaatgtcctcgcgatctacgccatcagcgtcggtacacaacgccggcatggcgcgaatctgctcttcattacacggcgccataaagacgaagtgccccgccccggccagtaatttgaaatcaggcgctgttggcagtttgcgcgccagcgccgccgcgttcttgtcgaaggccaccagtttgtcgccatcgccgctatagagcagcaccggcacgtgcacatcggccagggtatgacggccgaatttcaggctaagcggcgccatcaacagcaaggcgtggacacgcggatcggccaccggttgcaggtcatcgcgatcgacgatcagttccccttgggtgttgcaggcgtcatggtcgtccggccgttcctggcaataacgccgcaggcgatccagatccggttgcgcaccggatagaatcaacgcggtttcgcctcccgccgaataaccgatcacaccgacctgattggcgttgacgtacggcgcaagcatgcggtcgcccagggtcgcggtaatcgcttcggaaatctggatcggccgcccgtaaagattactcagggtgcccagccggctgtggtctttggagttgtcaccggggtgaatcaccgccaccacgacaaaacctttgcgcgccagcgacgtcgccagatcgtgcagcgccagcggcgtgccggtgttgccgtgggaaagcatcagcatcggaaagcggccaatggcgactttggtgtcttcgccggcctccactgaatagccctcaagcaggctcatatgctcacggtcgctggagggatagaacgcgatggcccgcatgggttgcaggtccagtggatcgaggaaggtcatctcgtgataaccgacgctccacacaggatgacgtccaggcgccgcttgcactgaattcaggctgccgagcaggcaaatcagtaacgttgcacaaagacgcatcatgggatgccccaccctgttgttactcaatcgaaagatccgttgcgttgcgggcctgaaatgccggggattcggcgtttcggtacgacaatgcattcagacgctgattctgtgattgcataacccgggccagattatgtaacagccagaaacaaaaaactccgtatttggcccttgcggaaccagaatacagagttttttgggtgttacctgaacctcagctgttctttgcgcaggccttacgctgcggcaaacagttgctcgctgatcttcgcttgggcggcagtcatggcgttgttgcgcacttcatcaccgtaggccaggccttcggcgcgaacgatctcgatgtcggtgatgccgaggaaaccgagaaccagcttcagatattcttcgtgggcgatgccgctcgcttgaccagcgtgaatgccgccagcagtggatacgatcaccactttcttgccaccgcacagaccttcagggccggcttcggtgtaacggaaggtttgaccggcgacggcaacgcggtcgatccacgctttaagttgagtcggcacggtgaagttgtacatcggcgcagcgataacgacggcgtcggcagcaatgaactcggccagcgtcgaggcgctcaattcggcttcgtgctgttgtgcggcgttgcgcagttcagcggtggtaccagcggcgaccagggtggtcgacgagaagtggctgatggcgtcggcggccaggtcacggtaagtcaccacagcgctcggctcggcgacttgccaggctttgacgacttggctgctcaactgacgggaagccgagttgtcgcccagaatgctcgaatcgatatgcagcagtttcatgtggaatctcctggaaggaatcgccgttggcgatggaatggagacaatcctacgcaagaaaccaatggatgattagccgcctgaaatgcgatagtttgtcccattgatagaacagtctggattcactcatgcaagacctcaacgatctctactatttcgccaaagtcgtcgaggccggtggctttgctgccgccgggcgtctgctgggcattcccaaatcgcgtttgtcacggcgcattgccgaactcgaagagcgcctcggggcacgtttgctgcaacgcaccacccgtcaactcaacctcacggcggtgggggaacgttatctgcgtcactgccaggcgatgctgctggaagcggaaatggccgatgaggcggtcgcgagcatgtccagcgagccacgtggtcgactgcgcgtctcttgccccaccggcctggcccgggaaatgttgccgtgggtcatcagcgaattcctcggcaaatttcctcaggtgcaactggaagtcgtattgctcaatcgccgagtcgatctggtcggcgaaggctttgatgttgcgctgcgcgtacgcgaacacggtgatgaagacccattgctggtcacccgacgcctgcgtcaggcgcaaatggtcgtggttgccagcccggattttgtacagggccaatcgatcaaccatccgcaagacctgaaaaatctgccggtgctcggcgcgcttgaggcagatcgcctggtgcatgtgcgcttgctcgatcaacagggcgaaagcttcgagctgaacatggaagcgcgactgggcattgatgactttattgtgcgcaaagcctgtgtactggccggtcagggttttactttgctaccgatgatgtattgcgaagaggaactgcaaaacggcacgctggtgcaattgctgcccgagtggtcactccccggcggctggttgcaagcggtgtatccgcatcggcgcggagtgatgccggcggtgcgcgcatggatcgatcacctggtcgaatcgttcaatgcctgtggggaacggttgttatgaagaagggaaagatgagcgaagcggacgtcgctgaattctgcctggcattgccgggggcgcgagaagattacaagtggggcggcgtgcgggtgttttcgattgccggcaacaagatgtttgccttgcagggactgcgcggcgattcactggcattcaaggtcgacaaggatctgtttctcggtcattgcgaccgcccgggcattcacccggcgccgtatctggcacgggcgcagtggatcatcatgcacccgccctaccctttgggtgccgaggaattgcaggggttgttgcagcgatcgcaccagttggtggtgagcaaattgcccaagaaaacccaaatcggtttattgctgtaaacccgatccctgtgtaggagctgccgaaggctgcgatctgttgattttgctttttagaagatcaaagtcaaatgatcgcagccttcggcagctcctacaaagggactcgtgcaggcgactagaacaacgccagcaagttcgagccgagaaacagctggtcgatccagaacacctgatgcagcagcacaatcacccagaacagaatctgaaacgacaccttgcgcgtcttgtgccggaacacctgctgggcgatcaacgcgccgggccagccgccggccagttccacggcgtggaggatgttctccggcgtgcgccaggcatcggcgcgggccttgcgcttgtcggcccaatacatgaagaacgccagcacactgatgaccccataggcggccaacggcacccacgaaatcccgcgcagccacatcgacagcgaaccgaacaatggcagcgcacagacgatcagcagaacgaccagtttcagtttcaggttctggatgttgttaccgcccgaaggtcgcccttcaggccggcgtgcgcgggaatcactcatggcttggccgccgcccagtccacccagccgaactgccaggtcgcgagaatcagcaggccaaaaacgatccgataccaggcgaacgccgcatagctatggctggcaataaacttcagcaagccgcgcacggcgatcatcgcaaagatgaacgccgtgatgaaaccgatggcaaagaccgggaagtctgccggtacaaacaggtcgcgatacttgtaacccgaatagaccgctgcgccgaccatggtcggcatcgccaggaagaacgaaaactccgtggcggttttacgtgacaggccaaacagcaggccgccaatgatggtcgagccggaacgcgaggtgccgggaatcatcgccagacactgggcgaagccgactttcaatgcatctttccaggtaatctcgtcaacggtttcggcatgcacctcgtgctgacgcttttccgcccacaacatgatgacgccgccgacaaccaatgccgctgccaccgtaatcggattgaacaggtattcgtgaatcagatcggcaaagatcacgcccaacaccacggcgggcagaaaggcgatcagcaggttggcagtgaaacgccgtgcgctgggctgagtcggcaagccgatgaccacgtcgaagatcttgcgtcgaaattcccagaccaccgcgaggatcgcgccgagctggatgatgatgttgaacgccatggcccgctcaccaccgaagtcgagcaagtcggcaacaatgatctggtgtccggtactggaaatgggcaaaaactccgtcagcccctctacaactcctagtatcagtgcctgcaaggccgtccaaagatccatcaatcccccaaagagcgatgcgcgccggcatgccccgatagtatttttttacgttcactgcgatcagcgtagctggtaaatgctgtaccgattccgcgcgcacaggatccagaccaaacagtcaaaattccgtgaaatatcaacttggattcaggtttttacgcgcggggccgaaatcctatcagacaagccttaatagcgctgctgcgttatacgacttgggtcgcgtatgcccgcccacgtaaacgtggttggatgctggcgatcgtttattacaaaaacaagaatccggagtgacagcgttatgaacagcttgcgcagtgtgtcgatcagccgacgcttgtggctcattttgattgtggcggtggtcatgttgctgaccttgggcgtattgatgctcaagcagatccacgatgacctgtatcacgccaaagcgcagaaaacccagcatgtggtgcaaaccgccagcggcctgctgacctattaccacgacctcgaaaccgccggcactttaaccaaagacgcggcgcagaagcaggcgctgacagcgattcgcggactgcgttatgaccagagtgactatttctggatcaacgacctcacgcccgtgatggtcatgcacccgaccaaccccaaactcgaaggccagaacctctcggcgatccgtgatccggatggttttgcggtgttcaatgaaatggtcgccatcgcccgcgccaagggcgccggcatggtcgactaccgttggccaaaacccggggccagtgagccggtggcgaagacctcgtacgtcaagctgttcgaaccgtggggctgggtgatcggctccggcgtttacgtcgacgatgtgcaggcggaattcaagggccaggtgatcaaagccacgatcatcggcttggcgattgccatgatcatggccttgctggtcatcctgatcgcccgcagcatcgtgcgcccgttgcaggaaaccgtgaacgcgatggccaacatcgccagcggcgaaagcgacctgacgcgtagcctcgatacccacggcaaggacgaagtcaccgaactggcgcatcacttcaatgctttcaccgccaaactgcgccgggtgatcggtgacttgcaggtctcggccagcgcactgggccaatcgtccagcgagctgggcagcgacgcctcgcaggcgcagcaacgcagccaacagcaatcgcagcagatggaactggtggccaccgcgatcaacgaggtgacctacggcgtacaggacgtggcgaagaacgccgagcatgccgccgctgaaatgcgcgatgccgaagcgcaggcgcagcagggccagatcaacatcgacggcagcctgcaacagatcgacaagctttccgggaccatcgatcaagcggttgaggtgattcgcaccctcgcggccgaaagcactcagattggcagcgtactggaagtgatccgctcgattgccgagcagaccaacctgctcgcgctcaacgccgcgatcgaagcggcgcgggccggtgagcaaggtcgcgggtttgccgtggtggcggatgaagtgcgcttgttggcgcagcggacgcagaagtcgacagcggaaatccagtcgatgatcgaacgtctgcagaaccattccgaagccgccgtgaaggtcatcggcgacagcagcaaggcgtcgcaactgaccatcgagcaagccgggctggccggtgccagtttgaatgcgattggccaggcgctgcgtaacctcaatggtctgaacgcgtcgattgccagcgccacgctgcaacaggcgcatgtggtcgaggacatcaatcagaacgttacccaggcggcgggcctctcgcacagcacggcgattgcggccgaacagtcgagtgccgccagcgtgaagctcggccaactgagcgaacaactcaacggcctgctacgccagttccgcgtttgacctcccccttgtaggagtgagcctgctcgcgatagcggttttgtcagcaacactaatgttggctgatagagcgctatcgcgagcaggctcactcctacagttttttgggtacaatccgctcccttctttatgtccccccaaggaacctccatgtccgggcttgaactgtttgccgccaccctcggcgtgatcgccgtctggctgacggtcaaacagaatccatggtgctggccgatcgggctggtcatggtcctgctctacagctggatcttctttgaagtgaagctgtattccgacatgttgctgcaagtcatctacgccgcgctgcaggtctacggctggtggcagtggacgcgggccgggacgatgcacgacgggcggcaggtcacacgtctcgatcagcgttcaattctgatcgggctcagcgtcggcgctgtcggcagcctgctgctgggcgcggccatggcgcactggacggatgccgcgcagccttggctcgacgcagcgttgacggcgttcagcctggtcgcacagttatggatggcgcagaaacgtctgcagtgctgggcgctgtggtttgtcctcgatgtgatctttgtcgggctgttcatctataaggatctgtacctgacggcagccttgtacggcctgttcaccttgatcgcggtgcaaggctatcgtgaatggcgcgccgacccggcgttgcgcacatgaaagtcgtggtgcttaccgggccggaatccaccggcaagagctggctggcggcgggccttcagcaacaattcggcggcgtgcgggtggacgaatacgtgcgctggttcattgagcagaacccgcgcgacacctgcctggcagacatccccgaaatcgcccggggtcagttgcaatgggaagatcaggctcgtgcgcaaagaccggcgctgctgattctcgacacgcacctgctgagcaacattttgtggagccagacgctgttcggtgcctgcccggcctggctcgaaccccagctgttggtacgccaatacgacttgcacctgctgctatctccggagcacatcgactggaccgatgacggtcaacgctgccagccggatccggagcagcgtctggccttcttcaacgccacgcgcgcctggcttgagcaacatcaccaatccgtgcaaatcattcagggcgattgggccgggcgccaggcgcaagcttttgcagctgttgcgcaactgctggccgaataaccccgatcaagaggctcctgccccaccgttttcccctgttctgggggaaatgtgtccattcctgaaacacacacctgacggcaaagtggccgtttcaacagtcttgaccgttttgtcggtcggcctgttacgtagttgaaacacatcgccgcaaaccctcgttccagagctttgttcagccaatagacaggtcggtgtcactgtgcgtgtttcaacaatgaaacagttcgtgtatcaaatctttgttcaattcatgtaagcatttgaaatcacgaaacatttaaaaagcggcacagctttcgctctctccttcacaacgctgactagggccagcccactgaagaaggaattgctgccgtggggaatttcaaaaagagcatgacctgcctcctgctgatcggatcagcagccagcacattgatcagcctcaacgtgcaggcggaaggtaatggcgtcatcgtcctcaatcgcgacgttcaacctattcctatcggtcgcaacggtggcaaagacccctacccgaccaccgtcaatgccaacccgtcggcacgcatcaatcagaccttgagcagcaccgaactcagtgacggtgacttcgccagtgtcgcgagtggctcatcaattcgcggcaacatgaccacgcccagctcgaaccttcccggcatgaacactctgaccaataccaacggcttgcctggcatgagaaccggcagtggcggcggtgcgggaggctcgatctccaatacggtcaaccgcgccatgagcaccggccttgcccctctgacccgaatggccggaggccaataagatgaatcgcacttttcttctgctcgccctgctcggttgcaccagcgccatggctgccgacccaagctcgatcaatagcgcaaacattcaggattccggggcgcaataccgcggcaacttcaacgtcaaccaggccgctggtgaccagatgcaacaggccaataccaaggcgattgccatcggcaccgaatcccacgccaacaccagcgtaatgcagaaaatcgatacgccagccagtcgctcgatcaacgccagcgccaacatcggcggcaactctttcagtaacggcaacgggatcctgggtgtgaaccagggcgccggggccaacaaccagatggccaacgtgacgcgcgtcagcatcagtgctgccccgcagagcgttgacgacagcgccctttcgcaacagaacgtggcgtttttaccgagctcaggagcaactggtacctcacccggcagtcgccaggtcacgacaagtgatcaggccttcaccggcagccgcggggtaatccaggtgaaccagagtgccggggtggggaaccgaatggctaacaccctgagcatccgggtcgctgactgacccaaacaacaaaagcagtgcaattagaaagtaccaacacttaaccaactaataagcacgatggagaaacaccatgaaacctacaatggctctcaaaccactggttttcgcacttgcagcagtgatggcaatcgcagcacaggcaggcggtcgtgatgacgatcatggtaatgggcacggcaacggccacggcaataaccagcctaaaggtccaaccctggaacaactgctgcaaatcactgcgggtgccggcgccgctgtgcttgatgtgcaagacagtgacggcaacgtggtaaaaaaccagggcacgctgaacaacgctaacgccagtgactcgctcaacggttccaacggcaacatgggcgccaacgttgcagccggcgacggcaaccagcaggacaacgctgctgcattggccaccgctgacgagagcttcatcttcggtaacgctgttgcagcctcgagcgcaactcaggtcaacaacaacaactacgtgaaaaactcgtcgaccttcaacaatgccaacctcaacaacgcaggcaacaatggttccggcaacatcggcatcaacgtcagtgcgggcaacttcaaccagcagaaaaacaacctggcgatcgccgtttcgggtggccgtgtagctcaggccgccgcttccgccaaccagtcctcgactggcctggtggtagaaaacaaaggcgtgcaaacctacaaaaccgacaccctcaccggtacttatgctgctgctggcgtgtttaaggccaaaggcaccgcaaccatcgaagacgatgatcacggtggttacggcaatcgtggcggcggccatggtggcaacgatgaccagaaagccaagttcgaagccgtgggtacctttggcctcgctggcgtaaccactcagcaagtgatgaccaaagacggctggaaagcgccggtggtcaacaatgccaacatgaccaactcgatgaacaacttctccggcaacggtggagccaacgtctcgtctggtgtgggcaaccaacaaagcaactcgctgtccatcgccgcaggttgcagagcctgcctgtaatcgcgatcgaaacgaaagccccggcaacggggcttttcctcggttccacaaggcgtatcgatcatgcgaactcccgccctcctcgctttgctttgtctgtgtggcctgactcaggcagcgcagatgccagtggctgccctaccaggcggcgtgctggtttacaaggacgtgcaaagcttgcgtgagcgcaagtttgccgacatcgtcgaacaaaagaccgatttcagttgcggcgctgctgcactggcaacggtcctgcgccaagcctactggctcgacgtcgatgaggagcacatcatcaaaggcatgctggtcaacgctgaccaggacctggttcgtacccagggcttctccatgctcgatatgaagcgctacgtagaaagcatcggcatgcgtgcccgaggctaccggatcccgccagagaaactcgaagcggtgaccattccggtggtggtcctgatggacattcgcggctacaagcatttcgtcgtactgcagcgttcagacaaggattgggtgtacatcggagacccggttctcggccacaaacgctacaaacacgatgactttgtcaaaggttggaacggcattgtctttgccatcgtaggccctggttacgacaaggctaacgctttgcgcagtcctccggtgccactgacagcaaagaacaagctggatggtttcaaccctgtcaaagatgcggaattgatggatttcgggttcattcagagcgacttcttttaatcgccgagttagagagtgggactggatgtcccgggagcagcagatgaaaagctcatactggctggccgccgcctgcctggcagcgagtgcgtcgggttttgcacatgccggattcaaacccatcgaaatcaaagaccaagagcttgcagagctgcgtggtcgttatgtcatgccggggcggattatcagcttcggcatcgtcatgagtagcacttggcgcaatgccagcggcgacttgatcggggctgccacctcgatgcaggtccaagcgtctaccgtcaaaccggaattctacgtctcgaccatcaaggagtcgggcaatggcagtgttcccacactgggcaacggcaccgtgatcggtggcgccggcctcaatagcacgcagggtgtgacgcaaagcgtgcgcgcggcgggcgatggcaacaccgcgagcaacaacgtcgcgatcaacgtcagtgaagccagtcaggcgccggcgctgctgccgtcgcaaggccaggcgctggttgccgggcaaaccatcagcggcagcaacggcgcaggcagcgtccaggtttcggccaacagtggcggcgtacagatggccattcaggccagcggcaatcaaggcacagcgctgcaacaagtcgctcagggcggcctgctgcaaaatactcgcttgctgggcagtgccaacgtggtcaacaacctcacgcaactcaacgtcgtattaaacaataacggcagaagcgccggtgcactggactgcaacctgacccaactcggggccctacgcaatatcggatattgaactacgctgagtctcgatcattgggcttaaagggacggcttattcatgtatcgatcagtatcactgcgtgctgcagtgtgtttgagtacccttctcccggcggcgatgctgcaagcagctcccgatgccgacgtagaagcccttaaacgggaacttctggaactgaaacaacggtacgaagtacagcaacaagcactggcggtacttgaacaaagggtccgccaagtggaagaacagccggccgccccaccgccaaaaaggctggccaaatcgccgtcagacatgaaaggaaatcgcgttgccagcggggccgccacaggcacgggcgcggccgccgcatcgggaggcgcagctgggggcagtggcgcttcttacggtcaatcgttggccgacgattcacaaccggcacagagcgtgtcgaacctttacgacgaagccagcggtttctttggcgggggcaagttcagcgtcgaaacgggcatcacctattcgcgctacgacacccgtcagctgattctcaacggattcctggcgctggattcgattttcctcggcaacatcaacctggaccgaatcaaggccgatacctggaccctcgacctcacgggccgctacaacttcgacaatcgctggcagtttgacctgaacgtgcccgtggtatatcgcgagtcgacgtatcaatcgggtggcggcaacgaaggcgcggcaggcgttaccaccgaggaaaccgtcaccaaggatccaaccattggcgacgtcaacttcggtattgcgtacaagttcctcgacgagtccgtcaacacgccggatgcggtcgtcaccttgcgggtcaaggcgccaaccggcaaggacccgttcgggatcaaactgcgtcagaccgatgccaactccaacctcttcgtgcctgacacgctaccgacgggcaatggcgtctggtcgatcactcccggcatctcgctggtcaagacgtttgacccggccgtgttgttcggcagcctgtcctacacgcataaccttgaggaatcatttgacgacatcagctccaccgtcaaccagaagaacccgggcaaggtgaagatcggcgacagcttccagatcggcgccggtatcgcctttgcactgaacgaaaagatgagtatgtcgttctcggtgtctgacctggtgcaacgcaagagcaagctgaaacaggatggcggggactgggaatcggtggtgtccagcgacgccaacgccggttacttcaacgtcggcatgaccattgcggccaccgacaacctgaccatcgtacccaacctgtcgatcggcatgaccgacgatgctccggatttttccttcagcctgaaattcccgtactacttctaagcagcgcaacagcaaaagatcgcagcctgcggcagctcctacatcggatgttggtaatcccggtaggagctgccgaaggctgcgatcttttgatcttcagccaactagcgaatctgatgtttatgtaacaggcgatagaacgtggggcgggaaacgccaagcaccttcgcggcaatgctcagattgtcgctatgccggttcaacacatcgcacagtgcctggcgttcagcacgggttttgtaatcttccagcgtgcccatcggtgtcgcgatcgaatgctggctgatcaaccctaaatcgcgggcctcgatctgccgcccttcagccagcaccaggccgcgccgcacgcggttagccagttcgcgcacgttgcccggccaatcgtgtttacccatcgcaatcagcgcatcttcactgaagctgcgcggacgtcgaccggtttcgtggctgtagaaatgcgaaaagtggttggccagcatcgacaagtcaccgtgccgttcacgtaaaggtgcagtgaccacttgcagaacattgagccggtagtacaaatcctcgcggaagcgcttcttctcgatcgccgactcaagatcgacgtgggtcgctgccaacacgcgtacatctaccggaatcggctgactgccaccgacgcgctcaatgtgtttttcctgaagaaaacgcagcagattggcctgcagctccagcggcaggtcgccaatttcatcaaggaacaaggtgccgccgttggccgcttcgatacggccgaccttgcgctgatgcgcgccggtaaacgcacctttttcgtgaccgaacagctcggactggatcaagtgttcgggaattgccccgcaattgatcgccacaaacggtttgctgtgacgctgcgattgccgatgcagggtgcgcgcgaccagctccttacccgtgccgctttcgccacggatcaataccggcgattcagtcggtgccagcttgctgagcaatttgcgcagttcgcggatcggtttgctgtcgccgagcaattcatgttcgggctggtcgacgtgaatcgtgccctgcccgcgcaggcgggccatgccgaatgcccggccgagggtaacttgcacccgcgacacgtcgaacggcagggtatggaaatcgaaaaaccattcgcagacgaagtcgccaacgttctgcaagcgcagcacttcctgattcagtacagcgatccattccgtaccgctgcgactgatcagttccttgaccgcttcgggccgttccaggtgaaaaggttgcaaacgcagcaagccgacatcgcagctgcggtcggtggcattttccagcgtacaactgtcgacatcccagcctatcgcgcgcaaaccgggcaataagcggtgacagtcgtcgcacgggtcgaccaccaataaacgtcttaacgcaggcgcttcgctcatgactgttccttggcgccaaatattagaaatgattgtaaaaacagtcatttggcagacccgactgtaacattagcaagattttgacagcgccttgtatcaattgcttataggtgtacaaacaaacgcgttataagaagcccggttgttagttagctatcgactatttcattacggaaaagctttcaacaagctttcaaagcccgtctgtgagccaggcgtttgtaagaaagttgaaatttctttgtttcgagtgtgacccgtcccggggttgcgtgcatcagtacaagtaaccagccgaacggtaagcccaaccgacggcagatcatttgattgggcactatagagagacgatcccatgaccgccccgctccgtatcaacgaagctcttttgattgccaaccacgccttcaaaccctttcaatgtgtggcttgggcgccacaagacggcaacggcgaattgagcctgaccgtcgtcgaccgcaccaactcgcacattggtcgcaagcagattccaagcagtgcctattccgatccggcacaactggagcaactgctgcaacaagctcgcgccgagttgagcaaagaaggccatctgttgcaatcgtggtcgatgccgcactaataccggaacaatgcggatgacctcgagtcatccgcccgtgttttcttagttgcactatctatttacccactgcttacttttgtacaactttcagcgtgagctttcggcgcgactgcttggcacacttgctattggtacaaaaagacactgttctggcacagtctgaccctccgcctgttagttctaacagttgtacttcttccgcttcagggattgaatgttccgctcatgcagtaaacctcccaatccagggtattggtctactcgcaaggagacgcgtgcatgtcgacccagagctcttgcacccgattggagcgaataaaccaggccggccaactggaccctgcttttgccggcaatggtatcgctcaagtgtattttgccgacagtctttccagcatgacccacggtgtcgcggttgatcggcaaggtcgcgtgctggtcgcagcgaaagtcaaaacccggaacggtagctgtttcgggctggcgcgcttgctcgcagacggctcggcagatttgagcttcggtcggcagggtagcgtcatcggcatgttttcatccgggttcggcagcatggccggcaaagtccagctgctgcccgacggcagaattctgctggctggcctgcactacgagaccgaccattgcaccctgcccggccttgcccttttcgatgatcggggttgcccggaccctgatttcggcgataacggttatctggtggtacgcctgcccggcgacctgtcgatgggcacactcgacgagtggctgccaccgggcattccgggcgccgaagcgtgtgacatggcggtgcaggacgacggccatatcctgttggttgccaatcatcacttcgaatgcgctgaccacgcgggcatgctgattcgcctcacaggcaatggccaactcgacaagactttcaacggtcgcggttttgtcatggttcgtcatctgctcctcaacacctggctgagcagtctgtcgttgcaacaggacggacggattttggtcggtggttcaatgagcttccctcaggaaggtctgcttgcgcgctacctggcggatggccggctcgacgaaaccttcgctatcgatggcttcatggccttcacagcccacggacacggcgcgctggtcaatcaggtggttgagtcggcggagcatcttcactgcttcggcagcagccgtgatccgattcgctgcatgaccctgaacctgcatcgtaacggtcgtgcgcagctacattgcaactcaggcctgccgcaactgctggacatcggccatagcggttgccagtggaatgccgcccagcgcatgcaagacggccggattatcgccgtcggtgcgacgattggcgggttcgaggcagacttcgtagtcgcgcgctatttacctgacggccacctcgatcaaacgttcggtgatggcaacggctggctgcgtacgcgtttgggtcgcagcctggacatggccaattcactggccgtgcaagcggatgatgcgatcctcgtgggcggctactcgctggatggcaactatcgggcaatggtggcgcgataccttaacgattgaaaaacacggactgtacttgatcttcggcaacgcatccggcaacttgcgcgcttctaaaagacaaggagcaaccgatgtccggttcaatggtccaggcgtttgcgcacaactttctcggtcaatcgccgcgctggtacaaggcgaccatcgtcggttttctgatcctcaatgcactggtcctgttcacggttggccccgtcgcggctggctggttgctggtcatcgaattcatcttcaccctggcgatggcgctcaagtgctatccattgatgcccggcggcttgttgttgatcgaagcactgctgctgaagatgaccacgccgcaggctctttacgatgagttgctgcacaattttccggtgatcctgctgctgatgttcatggtggcgggcatctacttcatgaaggatctgctgctatatctgttttcgcgcctgttgttgggcgtgcgctccaaagcgatgttatcgctgatgttctgttttctttcggcgtttctctcggcattcctcgatgcactaacggtgacggcggtcattatcagcgccgctgtcggcttttactcggtctaccatcgggtggcgtcgggcaatgacccgcgtcaggacagtgagtttggcgacgaccagaacctgcccaaattgcatcacaacgatctggaacagttccgcgcgttcctgcgcagcctgctgatgcacggtgccgtcggcacggcattgggcggtgtctgcacactggtgggcgagccgcagaacctgctgatcggccatgaaatgggttggcatttcgccgagttcttccagaaagtcgcaccggtgtcgatgccggtgctggcagctggcctggtgacctgtgtgttgctggagaaattgcgctggttcggttacggcacgctgctgccggacaacgtgcgcgccgtgctggccaactacgccgctgaagacgacgccgagcgtacaccgcgccaacgcgctgcgctgctggtgcaaggtgcggcggcattgatcctgatcggctgcctggcctttcacattgctgaagtcggtctgatcggtctgatggtgattgttttgatcaccgcatttaccggcatcaccgatgagcatcgtctgggcagtgccttcaaggacgctatgccgtttacagcgttgctggtggtgttttttgcggtggtggcggtgattcacgatcaacagttgtttgcgccgctgattcaatgggtgctggcgctgccggtggagcaacaaccaggcatgctgttcattgccaacggcttgttgtcggcaatcagcgacaacgtgttcgtcgcaaccatttacatcaccgaagtgaagcaggcattcctcgccgggcacatgagccgtgagcatttcgagaccttggcgatcgcaatcaacaccggcaccaacctgccgagcgtagccacgccgaatggtcaggcggcgtttctgttcctgctgacgtcggcgattgcaccgctggtgcgcttatcgtacgggcggatggtgtggatggcgttgccgtacaccgtcgtgatgggattgctgggctggtatgcagtaagttactggctctgaccaataccgcgtaaaaactgtaggagtgagcctgctcgcgatagcggtgtgtcagcccaagaaatggtgactgataaattgctatcgcgagcaggctcactcctgcatttggttttgggtggagtcagtgagggaggatgtatttttcgatcgcttgggcgacgccgtcttcggtattgggggcggtgaccacgtcggcctgacgctttaccgcctcttcggcctgacccatggcgatcgacagtccggcgcaatggaacatcgccgggtcgttgccgccgtcgccgattgcggcggtctgtttcagcggcacccccaagtgctcggccaaggtcgccagcgccgtgcccttgttagcctccagtgccgtcacgtcgagatacaccggttgcgagcgcgagacttgcgccatgccgttgaccttcggcagcaagcgcgcctccaattcaatcaacagctcggtgttgttactggtcgcaacgatcttgtcaatgtgctccagatacggctcgaaactctcgaccaccaccggcggataaccgaggccatgctgttcgcgcggcaccatcggcccgtgcggatccttgagcaaccagtcgccgccgctgaatacccagatttcgacatcaggctgatcggcaaacgtcgccagcgcaatcaacgccgtggtggccggcaagtaatgcgcgaccagcaaactgccatccgggttaacgatggtgccaccgttgaacgccgccgtcggcagatcaacacccaaggcttcgatctgctgcaacatggctttcggtggccgcccggtggcgaggctgaataacacgccggcttcgcgcaacgaacgcaccgcatcaatagtgcgctgactcagcgagtgatccggcagcaacagcgtgccgtccatgtcactgagcagaaaacggacaggttgtttcgacaagtcactcatccgaggccgtgccagacgcggccatcgcgagtcagcagatcttcggcggcttgcgggccgtcgttaccggcggcgtaagcttgcacgctcgcatcctgctgccaggcgtcgaggaacggctgaacggcgcgccagccgttctcgatattgtcggcgcgctggaacagcgtctggtcgccggtcaggcagtcatagatcagcgtttcgtagccggtcgatggctgcatctcgaaaaagtctttgtaggcaaaacccaactcgatgttggccatgttcagcgccggccccggccgctttgccagcaagtcgaaccacatgccttcgttcggctggatctggatgcgcaggtaggtcggctgcaactcatcgacttcggtgtcacggaactgcgcgtacggtgccggtttgaagcagatgacgatctcggtgtcgcgcacgctcatgcgcttgccggtacgcaaatagaacggcacgccgacccaacgccagttgtcgatcatcaccttcagcgccacgtaggtttccgtggtgctgtcaggggatacgttgggctcctggcggtagccgttcaacgccttgccatcgacttcgccggcgctgtactggccacgtaccgagttggcccgcgcctcttcagtcgtccacgggcggatcgcaccgacgaccttggccttctcaccgcgcaccgcatcggcgccgaatgcggccggcggttccatggcaaccatggcgagcaactggaacaggtgattgggcaccatgtctcgcagggcgccagtgtgttcgtaaaaactgccacgggtttcgacaccgacggtttcggcggcggtgatctgtacgtggtcgatgtaatggttgttccagaacgcttcgaacaggctgttggagaaccggctgaccagaatgttctgcacggtttccttgcccaggtaatggtcgatccgatagatctgcttctcggacatcaccttgagcaaacaggcgttcaacgcttcggcagtgtgcagatcggagccgaacggtttctcgatcaccacccttctgaacgcttctggattctcttcaagcaaaccggcgctgccgagtcggcgcaccacttcactgaagaaacgcggcgcggtggccaggtagaacaccgcattaccggtgccgctgtcggcgattttcgccgccagggctgaataggtgctgtcgtccagaaagtcgccctggacgtagctgatacctttggcgagcttggcccacaaggccggatccagcatctgatcgcccttgccgactttcgccgccacttcggtacggatgaagtcttcgagcttctgcgcgaaggcctcatcggtaatggcgttgtggtcaacgccaacgatccgcaggttttcgtcaagcaagccgtcgcgactgaggttgtacagcgccggcatcagcaagcgcttgaccaggtcgccgtgggcaccgaacaggaacagcgtggtcggtggtgcgggttctgccttggatttcctgcggatcgtatgggtcatttcttcggtgtctccacgtggccgccgaagccgaagcgctgggccgaaaggatcttgtcgccaaaggtgccctgaccgcgcgagcggtagcgcgagaacagcgagttcgacagcaccggtaccggcaccgcttgctccatggccgcttcgatggtccattgaccctcgccgctgtcggcaaccgaaccggagaagccgtcgagcttcggatcgctggccagtgcgtcggcagtcaggtcgagcaaccacgaggaaacgacgctgccgcgacgccagacttcagcaatgtcagccacgttcagatcaaaacgctgatcttccggcaggcgctcgctggatttggtcttgaggatgtcgaagccctcggcgaacgcagccatcatgccgtattcgatgccgttgtgaatcatcttcacgaagtgcccggcaccggcaggaccggcatggatgtaaccgtgctcggcacggtggtcatcggacttgcgatccttggtacgcgggatgtcacccatgcccggcgccagtgcggcgaacagcgggtcgaggcgctgcacggtttcagcgtcgccgccgatcatcatgcaatagccgcgctccaggccccagacgccgccggaggtgccgacgtcgatgtagtgcaggcccttctcgttcaggatcttggcccggcgaatatcatccttatagttggtgttgccgccgtcgatgatggtgtcgccggcttcaagcagtgtgctcagggtgttgatggtgtcttcggtcggcgcgccggccggcagcatcacccagaccgcgcgcggtttggccagaccggcaaccagtgctggtaggtctgcgacgcccgtggagccctcggcgaccaggttatcgatgaaagcggtattgcggtcgtaaacaacggtggtgtgaccgttgagcatcagacgtcgcgcaatattgccgcccatgcggcccagtccaataatcccgagttgcatgtgctgatgctccttactacaaataaatgtgtgtcatgggttatagcccaacgcgactgatggaggttagtccagagcgttgcgatgaagtttccgtgcattgtgcccgaatcagactgataacgccccgaaacgtggcgaagacacaccgaccatgaaaaataaaaaagttccattcacaggcaaaagaaatcaaaattggcgccgatagtaagtcagcagccaaaaacggcagcgacttacagttgatgcacgccatttgcgaggtgagcaatgggcacagtacacacagcaatgccgccacaaaccctgtacgtgacaatccgtcgcgatgaattgcgccagttgaaagacgagcgtgaccaactcaagcaggagctggcgcaactgcgcgcgttgactcagggcgctcagcccaaacctctgccggttgtccagcgccacccgcacgcctgatctccccgcctgcttcgggagcgacctgtgtcgttcccgacatgatccagccctttgtgtaatctgcaactaacaaagttttcacattagcttggcgatactccggcgcattctggccgggcgtacgcgttcggcctccgttcgtcggtttcatggaagctttccggcggtggttgtgacgatcgagctggagtgctgaatggcattgttcaaacgcagcaaaacgactgcgacaggtttcgactgggccggttttctctggctgttcgttttcttctggtacttctcgggtattacccaactgctgatccagctcaccggtacctccggcttcaccgggttccggcaggcattcgtgatgagcgccatctggctggcaccgatgctgctgtttcccaagcgcaccaaactgctcgccgcggtgatcggcgtcgtgctttgggcctgctccatggccagcctgggttacttcttcatctatcagcaggagttctctcagagcgtgatcttcatcatgttcgagtcgaacgtgtccgaagccggcgagtacatgacccagtactttgcctggtggatggttccggcgttcctcgcccataccctgttcgcctatttcctgtggacccgtctgcgcccggtgtacctgccccgtggccgtgcgttggtcgcggcgacggccatcgtggtcgccgttgtcggttacccgctgatcaagcaaaccctgcgcaccggcagcttcgccgaaggtttcgagaaattcgaaacccgtatcgaaccggcggtaccgtggcagatggcagtggcctatcatcgctatcaggaaaccctcgccgacatgcagggcatgctgcacaacgcgagcaagatcgcgccgctgaaaaacctcaaggacgcaacggccaatcagccggcaacgctggtgctggtcgtcggtgagtcgaccaatcgtcagcgcatgagcctctatggctacccgcgtaaaaccacgccagaactggacaagctcaaagaccagttggcggtgtttgacaacgtcatcacgccacgcccttacacgatcgaggcgttgcagcaggtgctgacgttcgccgacgaagaaaatcccgacctgtacctgtcgaccccgtcgttggtcagcgtgatgaaacaagccggctacaagacgttctggatcaccaaccagcagaccatgaccaagcgcaacaccatgctcacgaccttctcggagcaggcggacgagcaggtgtacctgaacaacaaccgcaaccagaatgccgcccagtacgacggcgacgtgatcgagccgttcaacaaggcgctggccgatgcggcgccgcgcaagctgatcgtggtgcacttgctgggtacccacatgagctatcaatatcgttatccgccgagcttcgacaagttccaggatcgcaacggtgtgccagccggtgtgcgcgacgaccaggtgccgacttacaacagctacgacaatgccgtgctgtacaacgacttcgtggtgtcgagcctgatcaaggattacgccaaagccgatccgaacggcttcctgctgtacctctccgaccacggtgaagacgtcttcgactcggtcggccacaacaccctggggcgcaacgaaaacaaaccgaccgcgccgatgtacaccattccgttcatggcctgggcgtcgccgaaatggcgcgaaaatcatgactggaacttcgccggggatttgagccggccgtacagcagctcccagttcatccatacctgggcggatctggccggattgagcgctgacgagctggatcgcagccgcagcctggtcagtgacagcttcaagccgcgtccgctgatgatcggcaatccttacgaacgccaacagcggccgctgatcgacttcagtctgatgaagccgaaacagcccgatacgtccatagcagaggctaccgagcagtaaacacaaaaggggccagacatcggcccctttttattgcacaccccctgatctgcggcagcgcccagcaagtacgaaaaacgctttcaaataataatatttctcgtttgacactaaatcgcaggtcctcgcttcgtctttgaacaaacggattttttccctcgaagacaaggagtcggctgcgatgttcgcgcccatcacccgttccatgaccctcacgcttggcatgtgcagcgctgctttgagcgccgaactgctggctgaaaacgcgactgaaaaatcgccagagcccgccagttcagcactggaactggcctcaaccaatgtcactgctcaaggcctgggcaccacgaccgaaaacaccgatgcgtacaccactggtgcgatgagcaccgcgacacggatgaacctgtcgatcaaggaaacaccgcaatcggtgtcggtggtgactcgccaacagatggatgatttcaaactcggtacattgtccgaggccatgagacagaccaccggtattgtcgtacaacaccttgactcggaccgagtcgactattcctcgcgcggctattcaatcaacaatttccagattgacggcatgctcaacaccttcgaccggatgaaatccgattccgacaccatcatctacgaccgcatcgaagtggttcgcggggcgacggggttgaccaccggtgcaggcgacccttcggcgaccatcaacatggtgcgcaaacgaccgaccacccggttacaggcgctggccggcgtcagcggcggcagctacgacgattactacagctacgtcgacgtcggtggcccgctggccttcgacggccgcttgcgtggacggacggtactggcttatcgcgacagccagtcaatccgcgacaaatacgcgctgcaacgcgaagtcggctacggcattctcgaagccgacctgagcgagtccactgtgctggccgtcggttacgactatcaggacaaacacgtgcaaggcaccgcctggggcaccgtaccgtactggaatgccgatggcagcaaagccggactcggtcgctcgaccaacatggcgacttcgtggagttcctggccgctgcgcgacaagaccgctttcgccacgctcgaccagcaactgacagcgggctggcatcttaaagccgcgtatacccatcgcaacagtgacagcgacggcaagacttactacggcggtggcggcttccccgaagccgaccgcagcggcatgagcgcctacatgggacacatgatcggcgagcagagcatgaaggcttatgacttcaacgtctcgggcccctattcactgctcggacgcgaacacgaaatgatgttcggctatggcgaagccgagcgccgcaccgattcgccctatgcctacgacggcccgcgtgcagcggattacgaaagcatccgtgactggaagtacatgggcgatatcgccaaattccctgataccgttaccggcctgagcggctcaaaaggcaaaacccggcaaaaggccggttatctggcaacacgcctgagtttcactgaccgattacatgccgtgctcggcagccgctacggcagttgggaggaatccagtcgggacagctactacaacagtcagttgcagttgaccagggtcgatgccaccagtcagagccagaacgacgtctggacaccttatgccggcctgctctatgacctgacaccggaatacaccgcgtacgtcagctacaccgacatcttcaaaccgcagagcaatcgcgacagcagtcgcaactacctcgatccggtcgttggcagcaattacgaactgggtctcaagggcagcctgttggaggagcgcctgaacctgtcgacagcgttgttctggagcaaacaggacaacgttgccgaaatcgacgattcggtcgcaccggatcccgtcaccggcgaggagttctacaagagcggcggcaagggtaacaaggtcaatggtttcgaagccgaggtctcgggtgagattctcaatggctggaacatgaccgccggctacacctacacccactccgccgatggcgaaaagcaacgcagcaacaccaaccagccattgaacatgttccgtttgtccacggcgtatcgtttgccgggcaactggaacgccctgactgtcggcggcaccgtgaactggcagagcgacgtctaccgcaccgccaaccgcccggtcgggcgcggcgccaacgggcggatcaccaccaaacgtacgcggatcaatcaggacgcctacaccgtggtcaacctgatgtcgcgctatgagttcgacaagcacctttcggcatcgctgaacgtcgacaacctgttcgacaagaaatattacgacaacgtcggcttctacaacggcgtgtactggggtgatccacgcacagtgacattgagcctcgactggaagctctgatcccttcaacacgccactaaccctgtggcgagggggcttgcccccgttggactgcgcagcaggcccgtgctttttgccatcaaaagcgcgagtcgcttcgcgacccgacggggcaggccctctcgccacaggtgcacttaaccccgagttaattgcgcggggagaaaatctcccccgagttctgcttcatggacgaacggctccgacttgttcagtaggaggcaccatgaaaatcactaccgcaatccttaccgggctattcgccctgggttctgccagcgtctttgccgaaggcggcgctgagcgcatgcgttattactacgacaacttcccggttcaccacgccccgagcgagcagcagagcgacgccaacgcgaaagaaattcgcgttcccgccgatcagactgcgcaggtgaccgagtcctatcgcaactgagattcaccgagcaaccgatggacctcccaagtctccactctggcctgggagaagacagttgggcgccctcttcgggcgcctttttttatgcctgcagttccttgatccagaacagcatgcgcccgtgctccggattgaacatgcctggcgcgaagccgaatttgccgtaggcgttctgcgccacggcgttaccttcgagcacttcgagggtgatcttgcagcagccgcgctggcgggcgatgtcctcgactttgcgtagcattttctgactcagaccaagtccacgaaatttgcctaccaccgctacgtcgtgcacgttgaccaagggtttgcaggcaaacgtcgaaaacccctcgaaacagttcaccaaccctgccggctcgccaccgacaaaggccagcacactgaacgcgtgcggtcgacgggccaattcttccggcaagcgccgtagcagatagggatccagcgaatgaccgccacccatagggtcttcggcgtaatgattgagcacgatgccgatggcttcggcgtgcagtggattggtgtagctggcttgaagcacaagaatctctgcggaatccatttccatccccgaacacacaaatgccccggcgcgcaaagtgcacgctgataggccgctcgaccttagcgcgggcgtgatccgccgggcaacccgcaacagcaaaagatcaaaagatcaaaagatcaaaagatcaaaagatcgcagccttcggcagctcctacattgaaataccgtactctctgtaggagctgccgaaggctgcgatcttttgctgttatcaatgcccccaaatcaacgcttcagtccagccgagctcgaggaagtcctgcgcacgcagggcactttcaccggcacaaaaaaactcgtccagttgcggcggcttcaccgacgtaccgctaagcatcgcgtgcacttggccacggtgatggatctggtgctcgaacaggtgcgacagcatgcgcagtcggctgtcgtgctgcggtgtgtcacgggcgatggtgactatgcgggcaaggtccgcatcgcgtaattgctcgcaataggcgatcagacgccgatcaacgtgcgcctgttgttcacgcaacggggcagcttcggagaacggctcgtcctgattgaaaaacacataacagtcgggatgcggctcggcgccgcgccgttcgcgttccaatgcatcaacgtagaaccagtcgcaggtcaggatgtgattgagggtcaggcgaatactcgggaaaaaactcacccggggcgcggccagctcggcgtcgtcaagttgcgaccaggccttggccaagcggtgattggcccaggcgttttgataggccatgctcagcaagtgatgggatagcggttgactcatggtggcgccctcttcactcaagcgttggcaaaacgctgcaattgcatctcctgcaagcggctgagggtccggcggaagggaaattccagataaccctcggtgtacaacgcgtccattggcacctgcgcctcgatgtacagcggcactttgcggtcgtagcactcgtcgaccagcgcaatgaagcggcgcacgccgtcgtcatgcactgacaattgcggcagctcgcgatccccggcgatcacccgctgagcgccgtcctcggtgcctcgggcaatgcggccttcgcgtttccgggcgctgagattgggcacgtcgctcatcagaatagcccgatagctatcgcacagcgcgatgaaatccatggcggcaaacggttgttcgcaaagatcagcgtagcggcaccacagcaccgactcactggcctgaaccacgttcagaatccgatggccgaccggcacgggttcgctgctggagctctgtccctgtgtcagcgcctgaaacacctcgctcagtgcgctggccgaatccggcggggtgacaaagtaacgttgctcgatggcgccagggtgcaagcgatggtcctcggcgccattgaccgggacaacttgcatatgcgccttgatcgcggtaatcgccggggtaaagcggtcacgattgaaaccatcggcgtacagctcatctggcggcagattggaggtgcaaaccacgacgacgccctcgtcgaacatcacctgaaacaaacggccgagaatgatcgcgtcgccgatgtcattgacgaacagttcgtcgaaacacaggacccgcacttcattcgccagttctttggccagcgcgcgcaacgggtcggcgatgccggtcaactggaaagaacgctgatgcacccagcccatgaaatgatgaaagtgttgacgccgggccggcacccgcaggctctgatagaactgatccatcagccaggtcttgccgcgcccgaccggcccccacagataaacgccggtgaccgaatggtcaccggcatgcaaggcttcgtggcatttctgtaacacccagaccgcgtgttcctgggcttcatcctggatgaagccgttgtgttgaacagcgttttgccaggcacttaaaggggagtcgaaagtcatgcgcggcagtatgccacgatgctcacagggagatatccagccgtgcgattttcccctgctgtttacgctggcctgccggcaatggcgacagcgcaagcttgcactgcgatgactgaccgttgagcggcatgcgtcttgacagtaaatattatcagcatcatattgacctcatatttcgctcgtaattttattcccactgagcgatcttcatcgagggcgttgccatgcactacaaggtttttggccgtaaaaccggcctgcgcgtttcagaattggcgctgggcgccggcaacttcggcaccggctggggccatggcgcggaacgtgatgaagccaaacgcatctttgatggctatctcgatgccgggggcaacttcattgataccgccaatggctatcaaggtgggcaatcggaatcgatgctcagtgaattcattgccccggagcgtgatcatctggtgatcgccaccaaatacagtatgggtactacaccggcagacggcatttcccacaccggcaacagccgtaaaaatatggtgcgcgcggtcgaagagagtctgaaacgtctgaacaccgatcacattgatctgttctgggcgcatatcagcgatggcgtgacgcccatggaagaaatcctgcgtgggtttgatgaccttgtacgcgcggggaaaattcattacgccggactgtcaaactttccggcatggcgcattgctcgcgccgacctgctcgcggagatccgcggcttcgcgccaattgcggcgattcaggtcgaatacagcctggccgaacgtagcgccgagcgcgaattgctggccatggcggaagccctcggtttggcagccacgctgtggtcaccactgggcggcggcttcctaaccggcaaatatcgcaacagcgatgacaacaaccgtgccgccaaactcggcatgttggtgcatgcggaaaaaagcgcgcgggaaaccgccctcctcgacaccttgcttgccgtcgccgcagaactcgacgccagcccgacccacgtcgccattgcctggctgcgggaaaaagccaaacgctcgaccactgcgctgattccgatccttgggtcgcgcacccgtgaacaactcgatgccaccctgggtgcactcgacgtgcaattgagcgatgaccaactggcccgactcgatgtcatcagcagcacggcggcgggtgttccccacgagacgattgtcagctcgacaccgcgttttaccggttcgcagatactggatttgcctaaggttccggtggcgtaagacggttggagtctgctcacgaaggcgctaggtcagttagaaacagactggctgaactggcgtcttcgcgagcaggctcaatcagtgatcgactttgtgtcgggcggcgtagaggcagagcatttccatcgccaacgtggcggcggccagtgaggtgacgtcggcgtgatcgtacgccggggcgacttcgacaacgtccatgccgaccagattgattccgcgcaaaccaccgagaatctccagtgcctgcaccgtactcagaccaccgcacaccggcgtcccggtgccgggcgcgaaagccggatcgaggcagtcgatatcgaacgtcaggtacaccgggttatcgccgacccgtgcgcgaatcgcttcgacgatcgcctcgcagccacgccggtgcacttgtcgtgcatcgagcacctgaaaccccatgtgatcatcattggtggtgcgcaagccgatctgcaccgaacgcgccggatcaaccagcccctcacgcgcggcatgccagaacatggtgccgtgatcgacacgcttgccctcctcgtccggccaggtgtcgctgtgcgcatcgaaatggatcagcgacagcgtgccatatttgcgcgcatgggctttgagcagcgggtaactgatgaaatggtcgccgccgaaggtgagcatggcgctgccggcattgagaatgtgctcggcatgagcttcgatgctttccgggatgctgtgcggtgagccgtaatcgaaattgcagtcgccataatcgacgacggccaaatgatcgaacgggtcgaacgcccacggccagtggcgctcccaggcaatcccggtggacgccgcgcgaatcccgcgcggcccgaatcgcgcgccgggacggttgctggtggcggtgtcgaacggtacgccgctgacagcgacatcgacgccgcgcaaatcccggctgtagcgccggcgcatgaaactggtgatgccggcgtaggtgctttcggcggcggtgccgtagaggctatcgcgggtcatcgcctgatcgttctgcattggcacgtccatctcggcgctccttttgttattgatggctacggaaagtggtccacagacgcgtacgctgacgcatgtccttgaggctcatgctgcggtcggcgtacagccgattacgcacgtcggccggtgggtagatgtcggggtcattgcgcaccgcctcatccaccagcggtgtcgctgcctggttggcagtggcaaaaaacagcgtgttggtcagctcggccaccgagtcggggcgcaacatgaactcgatgaacgcgcgcgcggcccggggatgcggcgcatccttgggaatcgccagattgtcctgccagaccagcgtgccttccttcggaatgcgataagccacttcgaacggtttgttggccttgcgcgcctgatcggcggccatgcttgcgtcaccgttgtaggtcagtgccaggcaaacattgccgctggccagatcattgatctgccgaccggtggcgacatagagcactgacggttgcagtttctgcaacaacgcctcggcggcggcaagatcatgcttgtcggtgctgtagggatctttgcccagatagtgcagcgccaggccgatgacctcttgaggcgaatcgaggatcgcaatcccgcagtccttgagcttgctcgcgtattcgggcctgaacagcagatcaaggctgttcagcggcacatcgggcagccgctgctgcaccgcttcgacgttgatgcccaagcccagagtgccccaggtataaggcacgccataacggttgccggggtcgacagcggcgagtttttccagcagatccggatcaagattggcgtagcccttgagtccctcataggcaatatccttcatggcccccgccgccaaaccgcgcgccagcacactggacgacggcaccaccacgtcgtaaccgctgccgccagtgagcagtttggtttccagcacctcagaggtatcgaaggtgtcgtaacgcacgtgaatgccggtttcctgctcgaaacgctgcagggtttgcggcggcacgtaatcggcccagctatagagattgagggttttctcctcggcctgagcattgatgaccacggacaacaacagcgcggggaaacacagcttgaacacgggagccatgacgaacacctgaccggagaaagtggtggcagatgcgccgtcgcatacattagaaaaatagccatataattatcctgactttaccccggagtaatgtgatgctcggtcaactccacgatgtcgatctgcagttgctgcgcctgttcgtccgcgtggttgaatgcggcggtttcagcgccgcacagggtgatctgggtctgagtcaatcaagcatcagccagcaaatggccaaactcgaaacccgcctcggctatcgcctgtgcagccggggcaaaggaggtttcagcgtgacgcccaaaggcgagcaattgttgctggcggcacgcagtctgtttgaatcgatcgaaacgtttcgccatcaatccaacggtgtcgctggacgcttgatcggcgaagtgcgtctgggcatttccgaggcggtcgaacaatcggtactgcagcgcgtcgccgaggcgatccggcggtttcgcgagcgtgacgagtcggtacgcatcgagctgatcagcgcgatgcccggtgagatggagcgcctgctgctgcaacagcggctggacctggcgatcggatatttttcgcaggtgcaaagtgcattcgactattgccagttattcagtgaaacccagcatttgtattgtgcgccggggcatccgttattcagcgatccggcaccgaacgatgcggcgcttgaggcgtgcgaccgagtcgatcatccctaccgttttctacgcagtgacgagccgtttcagggcaaggtctgttcggcgcgttcggaacaagtcgaaggcactctcgcctttatcctgtcgggcaaacacgtcggctatctgcccgatcactatgcgcggggctggcaggacaaagggttgttgcgcaccgtgcgtgaaggtgcgttgagctttgaggtggcgtttcatctggcccggcatcgggcgcaggtgccgggggatgcgcaaaaagcgtttgaacaggacttattggccgccttcaaacctgtgcaggagctgccggaggctgcgatcttttgatcttgatccaaaaaaacaaaaacaaaagatcgcagcctccggcagctcctacagaatgggttcggctcctccccccaataaaacctgacctttcaggcaattattgctcgttgccctcgctgccctcttccggcattctgcgcctccattttctgacccggccccgcctcacggcgcgcaaaacaccatgaccgcctctgaaaaagtcccacgcaacaacgatctgctctacggcctcaacgaccgtccgcacctgaccgccaccgtgtttgccgcgctgcaacacgtattggccagctttgtcggcatcatcaccccgaccctgatcatgggcggcgccctcggcctgcacagcgaaatcccctacctgatcagcatggcgctgttcgtctctggcctcggtactttcgtccaggccaagcggttcggcccggtcggttcggggttgttgtgtctgcaaggcaccagtttttcctttatcagcgtgattctcagcgccggattcatggtcaaggctcgcggcggcggcactgacgagattctctcgacaatcttcggtgtgtgcttcttcgccgcgttcatcgaagtggtgctcagccagttcatcggcaaactgcgcatgctgatcacgccggtagtgactggcacaatcatcaccttgatgggcctgtcgttgatcaaagtggcgatgaccgacattgccggcggttttggcgcagcggatctgggcgcatccagccatctgtttctcgcggcactggtgatcggcacaattgttgtgctgaaccgcgtcgacgtgccgttcctgcgcctgggcgcaatcgtcatcgggctgacgcttggctacgtggtggcctggttgatgggcacggtggatttcgcctcgatgcctgaggtaccgctggtcagcgtaccggtgccgttcaaatacggtttcaatttcgactgggtggctttcgtcccggtcgcggtgattttcctcgtgtcgccgctggaagctgcgggcgatctgaccgccaactcgatgatctcgcggcaaccggtcaaaggcccgctgtacatccgccgcatcaagtccggcctgctcgccgacggcctcaactcggctatggctgcggtgttcaacagcatgccgatggtgacctttgcgcagaacaacggggtgattcagttgaccggtgtggccagccgttacgtcgccttcttcattgccggtctgctggtgatactgggcctgttcccgatgatcggcgcggtgttgcagttgatgccaaaaccggtgctgggtggcgccgaactggtgatgttcggcaccgtcgccgtcgccggtatcaagatcctcgctgaagccggtctgcatcggcgcaacatgctcatcgttgccatttcgctgggcatgggcctgggcatcgcggcggtaccggaagtcctgcgtgagctgccgcaagcgctgcgcaacattttcgaatcgccgatcaccgtcggggcgttgtgcgctatcgtgctgaatatcttcctgccggaagaattcattgagcttgaagaggacgatttcgatccggaagcttctattcttcaggtcatggaaaacccggagatgccggccaagggtgaacctgcccggccagcggctgtcgcacagttgaaccgataacgtctggccttttgatagaaagggctgcaccggcaacggttcagccctttttagttgagagaccgttcatgcgccgcctacacgccgtcatgctgtcaatgcttctgctgtcgctcagcgcctgtgcgctgttccccaaccgtgatccggtgaacatcaacgtggtcggcctcgaacccttgccgagccaggatctggaagttcgcttcgcgatcaagattcgcgtacagaaccccaatgaaacggctatcgactacaacggcatcgcgctggatctggaggtcaacggccattcgctggcgtccggtgtcagcgatcagagtggctcgatcgggcgtttttcggaaaccatcgtcagcgtcccggtcagcgtttcggcgttctcggtactgcgccagacactcggcctgagccagacgcaaaccctcgacaacctgccttacgtgctgcgcggcaagctcgccggtggcgtgttcggcaccatgcgctttgtcgacagcggcaccctgagcctgcccaaggcgactgccgcgacctggtaaaaatgccgtagtctccaaggtttattactcacactcatggaggctgcaggtttatggaaggcaccccacgctggacaccgagcggctgatcctgcgtccgctgaaattggtcgacgcccaggcgatacgagtagtagctgccgcagcctgcggcagctacagggtgttgcaagtcaacgatcaggtgttgaagcgtacgccgggtttcgcgcgctcatccacagtcaactcgaacacgtccggccgcgcatagtgccccaccacatcgtagtcataccgagcgcgcaccagttcatcggtgtcgatctcggcggtcaacagcccggcctcaccgcgcaacggcccagccagcacatcgcccatcggcccgacaatcacgctgccgccggcaatcaatggccgatccgccggccaattggcaacgtctatccccaaatcattcggcgacgcctgcacctggcacgcactgaccacgaagcagcgcccttcatgcgcaatgtgacgcatgctgacctgccacatctcgcgctcatccacggtcggcgcgcaccagacctcgatgcccttggcgtacatcgccgtgcgcagcaatggcatcatgttttcccagcagaccaccgcgccaagcttgccgacctggctgtcgagcaccggtaaggtcgagccgtcgcccttgccccagatcagccgctcggtaccggtcggcatcagtttgcggtgtctggccagcaatccggcttgcgggtcgaaatacagcaccgtgcaatacaaggtgctgcccgcccgctcgatcacaccgatcaccagattggcgccggtgcgtgcggacaaaccggccagtgcttcggtttccgcgcccggcacatcgatggcgttggcgaagtaacgcgcataggcctcacgcccctcaggcaatcgatagcccaattgcgtgccgaaactttcacctttcggataaccaccgagcacggcttccggcatcaccaccagtgccgcgccggcttcgatgattgcgttttcccaaccaagaatctgttccagggtttcgcctttaccgccgggcaaggcgccgatttgcagggctgcaacaattgacttgggcatcgcgatcactccatcagcttgagaggttgctgattctccggcgccaagggatcatgaataaagccctgatcactgctgaatgatatgagccaaatgaatatcgccaacgtcgacctcaacctgctgaaagtcttcgaagccctgcacgaggaatcgagcgcgagccgcgcggccctgcgtctgaacgtgactcaatcggcggtcagcgcggcgctgcgtcgattgcgcgaggtctatgatgatcagttgttcgtgcgtaccggccgtggtctggcgccgacactccgggccaatcaactgaaaccggtggtcagtgaggcgctgaacaaatgtcggcaaagcctggccatggtcgacccggccgccgatcagtacgaaggtcgctcggtgacggttggcctgtcggatgattttgaaattgcctatggtcgtcgcttgatcgaggaaatcgcccgcagtgcaccgaaactgcggctgatcttccgccagacccacagtcagatcgtcgcgcgggcgttgatggaacgcagtatcgacctggcaatcaccgccggcggctttgctgaacgcctgctcagccggcaggtattgggtgaagggggttacgcctgcctggtcgacccggcgagccttgcgccggggcagcagcaaatcactctggaggagtttgtcgctcgcgagcaccttctggtgtcgtccggcgggtttatcggtatcaccgacgaaggcttggccgcgctgggcctgagccgccgggtatgcgcgtcgacgacgcacttcgcggcgctgccctatctgctcaaggacagtcaggcagtggcgacgattccgacgcacgccgccgagggtatcgctgcgctcagcggtctggcattactgccctgcccgctgaacttgccgcgctatccgatcgagctgggttggcggaccagtacgcagatcgatccagtggtcgtcaaagtgcgcgaggcgattgccgccagcttcaggtaaaaagccttacttgttcgccgccatcaggcgattgacttcactgcgcaccatattggcgaattccggcggcgacatgccgtccagctccgcacgcacccactcggcccacttgcctttacgcttgccgcgctcgccgaacagccgcgcggcctcgcctttggctttgcccagattgttctgccagagttcgaacagacgggatttctcatcttccagcgctgcgcgctctgcgagggatttgtcggccagattgaaactcatggggaattatcctgctgcgtaaaatggcgacatcttacacgctcgacggaaatctcctgcgcaggtttttattcatgacctaaattcagtgcaactttttacgctgcgtcacactccattgatcactgtccattcacctgtaaggagtcacccaatggcccgcaaatccgccgttcaagcggccgaagaccaaatcaaggatcaggccttcagcgaacttcaggctctgatcgaagagtcggacaaactgctcaagagcagcgcatcgctggtcggtgaagaagcggaaaccctgcgcgggcaaattgccctgaaactgcagcaggcgctggactcggtttccagcgtgcgcgaccgcaccaagccggccgtcgatgccactgagagctacattggcggtcatccgtggcaaacagtggcaatctcggcgggcttcggcctggtggtcgggttattgctcggtcgtcgttgaatcatcgcgagcatgtaacagacaagaaaaaggcgagccccgtggctcgcctttttcgtgtccggaacgcactcaatccgcggccaattcgcgcaactgcgccaaggtttgctcatccagcacaataccttcggccattgagcgggtgcgctgcagatggcggcgatcacccggcaagcgcttcaatcccaccccatgcatctgtcgcaccagctcctgactgcgcgcggcaaagtcctgccccgcggctttgctcggatcgatgacgatcaacaactggcctgtccatggcgtccgcgcgcccggatgattcgaccagtcgaactcgaaggaaaaatggccgccggtcaatgccgccgcgagtaactccaccatcatcgacagcgccgaacccttgtgcccgccgaatggcagcaacgccccgccctcaagaatggctttcggatcgcaggtcggctgaccgaggccgtccacgcccatacccggcggcaagcgctcgcccttgcgcgcggcgatctgcacatcaccatgggcgatggcgctggttgccaggtcgaagacgatcggtgcgccgccggcacgcggggccgcgaatgcgatcggattggtgccgaacagcggccggtcggcgccgtgcggcaccacgcaggtcatgctgttgaccacgctgagcgccaccagaccttcttcggcaaaaggctcgacgtccggccagagcgcggcaaagtgatgggaattgcgaattgccaacaccgcgatcccggcgttgcgtgccttttccactaatagcgggcgggccgccgcaagcgccggttgcgcaaagccgttgccggcatcgacccgcacgaacccggacgccacgtcctcaaccagcggcacggcctgaccgttgacccatccgcttttaagtgtcgaaacataaccggggatacgaaacacgccgtgactgtgggcgccgtcacgttcggcaccggcacagttggccgccagcgtgcgggcgacgagcgcggacgttccgtggcgcaggaaaaccttttcgagcaactgcgtcagcgcttcgagcgacaacgcgggcgagacagcagaagacacagcatcgtgtggcgcagacatctgaagctccagactaattattggagggaacaacagcgtacgaacagcttgccctgcgattaaccacgtcaggcccgggtgctgtcaaccgttccgaagcgctcgccgaagcgcccatgcacattcgagcctctaacgtgcggtaactatgtaccaccctctctcatcgcaaggcttttagtctggccgttcaattcaccggcgcactcaacggcgcctgatcgagacccgacaatgcccgcttccgttcctccgctgctgttccccttttttctagactctcctggcctatgggccggactccgcactgcacatgacctgtccatccaggacttcaactggctgcagcatgtaaaactggccacccaggccctgcgcagtcagcaaacgccgcccatgcttgtccatcgcttgctgctcaacaccgcagaatcaccggcgctaccgctggcaggcagtttcatcctcagcaccactcccgaagaccgcgccttcctgctttacacgccgtttgaaggattgcggaagttcgccagcctcaaggtcctgaccgagcacctcgaacagcgcctcaacgatgctgacgaagaggatcggttactggcgtttctcgccctgtcgcaacgtaaatatctgttggaaaagcgcggtataaccgtaaccccccagctcatcgacggcgatatattcgatgatcaacgcgcagccctcgaacactgccaaagtctcaatgcccaggccttgctcgacgaactgttgcacctgcccgcgctcggcacgctgcttgagaacatcctcgccgacctgctggcatcaacgatgccgggtgtgaatcagacgcagacccgcctcgattttcacgcaggcgcagacagcccggaagcaacccgcccgagacgctggcccgattcaatgacactggctgatgccgtgctcctgtattaccgccatggcggatggcccgccgatcagacccatgtattttcccatccgcatcggctggccgaggctgacgatcaaatgcattgggagagcgcagtcaaaaacgtctccgtcaacctgctggcgcagctgtacaaacagatggaggtttactggagcggcgcaagcgccgatggccatacgcgccatgccttcttcactcaggccctccgccagcaggcgctcaccgacattatgctcaagcgcgaggcgggcatcatcgacgcgcaaaaatgcgccggcctgttggcatggatcgaacccgatagcgattccccccggttagccacgctggaaaccgtgcgtttgtgggaataccagcccaacttcgtcgagctggcaggttcgctgatgttcagccacaccgacgcctgcctgtacaccccatctcagggtttgcaggtgctcgcggattatcaggatctgaaaaataccctgctgagcaagttcagcgctgccggccatgaggaggaactttatggtttgctgagcctggaggaacgccaaaagtttcttggcttcgacgaacctcatgtctcaggtgaagtgatcgctggcgacatctttgccgtgctgctgtccggcatcatcaccaagcaacgccagaacatcgaatatgccttgcaggtatttcgtcacagtgacggtgcagtagacatccgcgcgctgttcgataaagcgctggatgtccgctcgatgctccatgatcgcctgctctcactcgatactgacgagcgctggactacccgcccggcgctcagtggcagcctgctgccatcgatggtgacagcggatagggcggcggccgaattcaagacgttcaccagtgtgctgagcgccatcagcgacgaattttttgcacagccgctaacaacgtcagcgttgcaaacccagtacctgggcaacattaaagacaagctggcgcatgcgttgtttgtcggcatgaccggtgaggccagagtccgcgtactcaacggtacgctgcagcatcatgagcaagcaattgtcgacacggtgttcaaccccggccaacctgaccgcgctcgacgcaagggccttaacggcttccgtcccgatgtcttttcactcagcttgcaggccaccggccagagcgagctttcgccactggcgaactgtctcctgctgaccgagcgcggtggcctcgataatcagcattctgggcacgctatattgtggaccccggcgctgggcctcgaagtcttcggctcgattgatacagcgcggcaagccttgaaccagcgcctgctcagcccggaaaaacgtctgctattgctggagaatctctcaccactcagccaaggttttcaccagaatttccgtttcgctgacttccatttgatcagcgaaaacgtgctgcatgaccgcatgcaatcgacgatcgaacactttctccagcgaggtaaatggctacgtgacctgaaactgcagaaatcggtagaagatcaagcactcaagaccctgagcctgcaagtgatcgacagcaatctgcatcacgccagcgcattggccaaagccctcggcaggcaacagtcgctgccggtatggctgggcatggccgcacttggcgatcagcaactgcacctcgaaatacttgagcagtggtgcaacagcgtcactgatgacaaggactatctgcacgggctgccgaccctgcatgactatgttcagcaaaccctgcagtcattgttgtccagccgtttccaggcaccggaccttgatccccggcacatcgcgatcaccccggtgctggccttggccggtcctgccatgagcctcaccgatttcgccctgaatcatagccacaccgcccagcaaaccagcttcaaggtgacgtcgggtacgaacgccgtgctgccgaagaatatcgaccagcaagcaatccgcagcctgctgctatcgctggatatcggctcgacgttcgccaacaagctcaccagcgcactctcagccaaaaatagcgatgcccaagcgcgccaacagcgctatgtccgtcagttgccctggcaactgctgcaacacgctcatcaattgaaactgcaacagcggttgagcgctatggccttcgacctgatcactcaggtactcgacatgccggatgccaccgcgcgcgcaagggtgccgggggccgatgcgctgttgcgtccactggcgctgatcaaaaccgccggagcaaaagccgtcaccgctcttggcatgtacctgatcggccccgcatccggcaaacccgggccacaagtgttgtatacgccgtaccacggtgaacaagcgttcagcgaatttgccgatgaagctgctgtcatctccgccctcaacattccgggggcactacagaacttgctgctgcgacggttgcccgccagcgaacaatcgatattcggcgcgctgttcaaggacagtatcgggcaaaccagcgaaatcaccctggcgtcaaaagctgtcgacggcaatgcgctgatgcaactgttcagtgacaaccttgcgttgttgccaggcttgctgagcagtcattcgttgccgtcggcacaagaggactgggaagtggcgaaaaacctcttcagctccggcatcaaactcgttcgcggactgctgccgggcaaactcgcctatgtgcagtttctctggcaagccttcaaggacgccatgaactccgccgaggcgctacaggatcatcactggaagcgcgcactggaaacgttcattgccggcgctgcggaaatgatctctctcggtcggctgtcactggaatcgacattgattacaaaagaagcatcgattcagcaggagcccgtcgcaacaacgcccagcgcgcctaaatggcaggagattcgccccactgcggcgtctcgcactaatctgcaaacgttcgaaacacccacggttgcgttgaaagacctgacgcataaagtggcggatggcacctatgaggatctgccgacgaaaaccctctatgcgccgatcgccggcaaggtctatccagtggagaagcctggagcggtctggcagatcaagggagccgaacaggcaggcccggtattgcaacacacggcatcccgacagctgattatcgataccgaccggcacaccgtgcatttcggcaaagccttgtccaaaatgtacaaccgccacgccaacgagcgagaagcccgggtctggttgaacatccaggctcagggcatggccgagattcgcgcaaggcacccggaaaaggcacggatgttgacccaggccgtcgacatggcccggtactatgcgctcaacagcctgcacaacatggcgcaactgaaaaaccacgcccccgggacgcgactggacacgttcctcaaatcgttcttcggcgtgcaacgcatcgatgccgacattctcgccaagatcaaaaagaccatcgtgccgatctgcaatgccttggtcgaccctaccgaagacctgatgaacaccgaccgcttcgtcgtcggctcgaacaaatacagcaacagcgggctgatcgccttcgtgcttgatgacgactcgcggaaaatggtgcatttcaccgaaaagttcttcaaccaggaactcgactggtacaaggtcggcctcacccagccgttcaacgtcgaggggcatgcccaggcatccacgctgatccatgaattcgcccatcaggccaacaaggcagtggacatcgcgtccctcgaagcccggcggccgttcagtgacctgattgccaccattaccggttacggcgcggcgatgaaagaaaaccagacgcgattccagcgcgaagccctgtcactcgaaacaccgcgcgaggagctgtttgcacgctggagcaatgaactgcaggagtggatcagcttcgatgagattccaggtatcgagcatgtcgccaaggaaattctcaaagtcacgcagagcccaaccgtcgaggatgcgcgaacggcatttctgagcagatccaatccacacccgcgcatcgacacaattttgcgcaacgccgattcgatcgcttttctgatctgcgaaatgggtcggcaacttgacccggttaccagcccgaatgaagcgctgagctgacagacaaaaaatgcgcaggcaagggtgcctgcgcatcgctttattacgcggtgatatcagtctttctgatcgcgcaacacattgcccgaggcaccgtcgatgcggaactcgtagaccacgccatcggctttgcgcccctcgcctttccagtaaccgttgttgtcggcttctatctcatacacttcgacgtaaccggccttggtcttgataatctcgatagccttctcgatggtgatccatcccgcacccggtcggtcggccatggccgcgccggcactcaacaaggcggcagtggccacgaaagctgcgaaggttcttttgatcattttttcactccatttatggatgatgttcctcagacgtcctgtttttgggtgtcggcgaggaaaataagttccaaattgatgggtaattgccatgacggttgttctcgaccaacggttcgcaaggttagaatgcagcaaaccaggatgagtcaatgaccgaagacaccctctcggaagccgaatacgatgcgatcaccgatgccgccgcgcattggtgcatgcgtctgcacgcagtcgactgctccgccgaggagcgtttggcattcgagcagtggcgcgatgcgcatccgctccatgccttcgaatatgaagccatgctggaaatctgggacgtcgccgagcatctgccgcgtccggaacccgtcgaaacgctgccggccataaaaccggccccggcctggcatccatacgccgtcgccgcctgcgtattcgcgctgggcctgccgctggccgcctacaccggatggaacatgggctggctgcccaacagctatcagcatttcgaagccagggacaatgtccgccaggtcactttgaacgatggcagtcaggtcgaactgaacctgaatactgagctgacctacagcaactacaaggacgagcgccaggtcaccctgaaaaagggcgaagcgtttttcagcgtcagtcacgacgtcacgcaccccttcatcgtcaaggctgccgaaggtcgaatccgcgtcaccggcactcgcttcaacgtgtggatgtacgaagatctggtacgcgtcaatctggtcgaaggctcggtgctggtcaccagcaacacggcattgcacggcgatggcctgcgtctaggcccgtcgatgcaggcgcagtacaggcatggcgactacacgccgcaaatcagccagacctacgccaatgacaactcactggcctggcgcaacggtaaactggttctcgacaacctcgcactgaacgaagcgctacccctgatcaaccgctatctgaacaacccgctgatgctcgccgacaccagcaccggcgcgatccgcgtgggcggcgtttacaacatcaaagagatcaacggcctcgtcaactccctgcccaaagtgttgccggtctacctgacccgcaatgctgaaggcaatccggtaatcaactcgattcccaagcatccaccgaagccctgacagcacctgtggcgtggggatttatcctcgacgggttgcgcagcagccccatgcaaatctcggttcagcccttcaaattcttcgccacctggaatgttccggctgctgcacagcccaaatacagtgcactgcatgccgaccaggtccggcgccacagacaattgtcagtaaaaaaaaacgccgccctcaatcagaggacggcggctttctcataccggtgcagaggcttattgcgcagccaccttcgccgctttatctgccgcctcgctgatggtctgtacctgatactgcggatcggcttcgatctgctcttgagtgaagggcaagacgctccattgtttcttcgaaaacgcttcggtctggtcacgcgagtatttcgacgccggatcgctggacagcgagaaggccagcagtccctgagcgtgcggccctttgtcatcaaaggtcaccacttgcagatagctggtaccgctgaccacttcgagtttgccgtcttcacgcgggacactctgaatggcgttgtagatgccgagagtacctggcccgccatgaatcgcggtttgctgaccgccactgctgaccacttggatatcgccccagcgggtatcaggcttgatgcccattttgctgctcagttcgagcgaggccaacatcgcttcgcgcacggctttgctgacgtcaggctgttcgatggcaagcccgcgcggcgtgctttgcgcggccttcgggtcgaacgcgacacgccagatctgcggtgattcctgcagggtttgcatgatgttctggaaatgcaccaggccgctgccggagtccaggttcgcgcggccgtcccaggcctggaggctggcgcagaccggcttcagtttgctcgcgtccgcaccaaggtcattcgcgcagaatttcagcaggtccggtaatacctggctcgccagatagacgttgtcgtccatcaccatctgttgcagatcctgcaccgccaacggacctttcttctccagcgaggcgaggcgattcagggcgaagcgcgagcgcatgcccagcggttggctgtcctgactgatcagcggcgagaaacctgtcagcggttgcaccgggttggccagccacgcggagtcgttggaatgctggacgaagtcttttcgcagcaattgcggcaactggctggaggcataaatgcccggctgcgcggcttgcggatcgatatcccaggcacagccgctgtgagaaccatccagcacgatcatccgcaagccggcacgcggatcactgcacttggcgagcttgtcggcgctgacgttcggcactactgacaggttcatgtacagcgtctggcccttgtcatctaccgccagtgtattgacccacggtatgccttgaatcttgtgtaccgaatcctgcagatccttgagattcgcggcccggttcatcgcataccactgattgagcacccggtcattttcgaggttggcatcgcgcaggctgaacgcgtattgatgatcccagtcaagcttgcccggccactgtacgatcggcccgaactgcgagctgtagatatcacgcgacactggcacgacctggccatccgcctgtttgacctgcacggtcaccgtctgcttgttcagcggcagtgatttgccgtccagcagatagcgcgtcgaatccttcggatcgagttgcaggcgatacagggtgaagtgcttggaagagtcgaccgtgtgggtccaggccagatgttgattgaaaccaatgttgatcattggcaaccccggcaacgcagcacccatgacgtcgagtctgccaggaatggtcaggtgcatctgatagaaacgcataccaccgacccaagggaaatgcgggttggccagcaacatccctcggccattgaaagagcgctcgctgcccaccgccactgcgttgctgccgcgatccagggcaaagcgttgttgacgcgtatcggccagttgccaggtgtgtgattgctgcacgacctgcgcactggattgcggcggtgtggcgccggccagagcctcggcgaactgcccgacaccgccttcaaccagcagacgacgggtcagtttgaccaggtcttcggtggcgatatcacggacccattcaccttggcattgttgcggcaacccttgctgacgacgctcggcgagatagtggttatagccggcgacataaccctgcatcaggtcgcgcacctcggtgggttgtgcctgccagaatgcctgcactgcttggggcgtgttcagccaggtgaagaacacatcgctgacccggttttcacgctcctcgacagtgaactggtccgggccgaaataacgcgagcgttggccgttcactgtaacgatctcattggccagcaagcacaggttgtcctgcgcataggcgtagccaataccgaaacccaggccgcgctcgttctcggcgcgaatgtgcggcacaccaaaagcggtgcgacgaatatcggcgctggcctgcgtggcgggactgagcgcatgggctgacagactcagcccgagaaacatgccagcaagggccaacccggttaactgcctggaaataatcacgctcgctcctgatcgataaggcaaggatcggcccgggcatggcgttgaaaatacctgtttcgccggagccgatctgaaattcatgcacgcgcctgggcgcattgcggctgttcaggaaacgaatcggcgaaaaaaaatttaggccggccgacagcaatgtggtgccgtgattacggggaaacgacaaataagcgacaaattttatacatattgcccttcatgatttgccgtgctgaaacgtcttgtttagagagagcactaaaaaaccctttcctgatcaggtcctgaaaaggagtcaccgtatgtacaactcgcaactaccaacggaaggtagccaggcgccacaaggagcttccatgggccccagcgccagcgatttcggacaaaggatcgagcgtcacggcaatgagcgaatccgcctgctgctcaaaagcttcggactgcgcaccagcctgattcgtctgaaggtcattgacgcgctgctgagcgctgcgcaaagccagcgtcgccttggcgtacgtggcgtgcacagccaattgctcgacctggacattccgttgtcgtttctcagcgtgcgcgaagtattgaagcgtttgtgcgccgaaggcgtgatcaccatcaacgccgacaagagctacagcctgcacccgcaggctgctgcgattctcgacaacgagtgatgcaaagcgcagtcgccgtcagggtttgaccttgcggcgcatcacgccattgatcactaccacgattaccgccacaccaatggcgatgtactggaacgttttctcactgatcgtcccggcgttttgcagccaggacaggccgagcatgatcgccagtaccatgagggcgatcagaatcgagtatttcaagcgttgcgactgagtcattgcagtttcctgaagcgttggaatgtatccggttcgtatccgcttgcatgccaggcacataccttgtttcggggatgcgcgacaattgccggagtctcatgttacagccgctgaagagttttggcttcatggcggcgtaaccatgaggattgtagaaatgttccgtcgaatcgcctggctgattcccctgcttgccgtgctgaccttgagtggttgcatcatatttccccacggcgggtggcacgctgaccatcatcgctattatggcggtggtcctggctactaccatcgatagaacaggattgctcgccccgctgagtgatggctgctcccattgattcaaaagcaaaaaatgctcgccttctggtgggcatttttttttgcttcagattctatcaaggagccgccagcgagtgcggatacgtgccgaaacaagccggtactttttgaaatcttctgtcgcagcaaagtgttatgccaccaaaccaagcactcataggctatgcaacaggtttttgacagaagagaaaaggttgcaatgcagagaacactcatcgtccttggaccggtaaaaattattggattttgcctggccattactctcttcgaacttttgacctacatggccagcgacatgatcatgccagccatgctcagcgtggttcaggagttcgaagcagacgcccgccacgtaccgaatgcattcaatctttacctgatcggcggagtctgcctgcaatggctgatcgggccgttatccgatcgttttgggcgacgacgcttgttgttgatcggctgcgctctgtttggtgtagccattacggcggccaccgcaacgggctcgatcgaagcattcaacgtattgcgcctgatccagggcatgggcctgggttttgtcgtcgccgtcagctatccggcactgcaggaggtttttcgcgagggcgatgccgtgcgactcatggcgttgctcggcaacgttgcattgctgtccccgctactcgcacccttgttggtcagtctgttgctggaatggttgagttggcggcagctgtttttcggcttggggtttgccaccgcattggcctggctgttattgctgtcgtgcatgccggaaaccattggcgcgcagcgcaatgatggcgtgcacctggcgccaacgccgctgtcattgaggcacgtcttacgacgctacgcagcgctgctgcacaatcgcaccttccttagcgcaagccttgcgctgggtttcatgagcctgccactgattgcctggatcggccttgcccccctgctgttgatgcaatggaaaggcctgtctgccgtggaatatggcctgtggcaaataccggtgtttgccgccgtcattgtcggcaacctgctactggatcgactgctgccaacccacgcactaccgcgcttgattcgcctggcgctctggccttactgcctggggttgcttgccctgctcggctcgatgctgactgacgaatccgtgccggcgctggtcacagcgctggcggtgtatgcggtcggcctgggcatgagcaacgcggtgctgtatcgaatcgccctgtttgccagcgatgacagcaaaggcctggtgtcagccatgatcggcatgctttcgatcgctgtcatgggcgctagcggctggttgatggcgacactcggaggcggcgccagcctcgaactctttggattgtgggccgccatcggtggcctgttgtgcctgcccctgttgcagcgggttctacgcacctgaccgggtgcactcccccctgcttccttctggatgatggatattgatgattaatcacttccccctgggcgatgcgctgtgtgcgttgccgcagccctattgcgccgattccgtgccggccggtctgttcgaccgggcgatggctgaaatcagtcactttcattgtcagcagacaccgggctaccagcactggctgaatgccaacggcttgcaggccagcgatctggacagtctcgatgactggtcgcgtttgccggcgatcttcgccaacttcttcaagcaaaaattgctgctcagctcaacgggagagaacgccatggagttgacttcctccggcaccagcggccagaaaagccgtatgcgctatgacgagcgcagcattgccggtgcgcaatacatggtcgagcggattttccagcattacggctggaacaccccggacacaccgtgcaactacctgctgttgagctatgaaccgcaggggcaaatcagcctgggaacctcctacaccgaccagttcctgtgtcgttttgcgaaaaccaatcgagtcgcctatgcgttgcgcaacactggcgacggacatcaattcgatgtgttcggagtgaccgccgctttgcagtcgtttgccgatgaaggtttgccggtacggattttcggtttccccgccttcctttggcagaccctcgagcatatgcaggcaacctccgtgaaagacctgcaattgccatcaggctctctggcgttttttggtggaggctggaaaacccgggccaccgaggaagtccccaaagcgcagctgtatgcacgcatccaccagcaactgggcatcgatagcgcgcattgccgtgatggctacggcgcggtcgaacatgcagtgccatatatcgaatgcagtcaccaccacttccatgtaccggtgtatgccaaagcctatgtacgcgacccggtcgacttcagcgtcttgccctatggccggcgcggcctgcttgggttcgtttcaccttacatctcctcaagccctgcccatgcggtggtcatgagtgatctcgccaccctgcatgccggtacaagctgcggctgcggattgagcgccgactggttcgaactgcacggccgtgccggcaccagcgccagcagaagctgcgcgatggctgcggctgaattgctcggagggcattgatatgtatttgatcaacggacaactgcacgccgattacgctctcgacatggctctggaacaactgcatgacgcgttgccgcatcatctggccacccctctgcacagcagcacggtaattgaagcggcagcgcggtttgccgagcgactgtgcagcggcgacagcaacgtcgtgctggatgaagaacagcgccaggcattgatcgggttttgtcagcctcaggcgctgcagagcaaacttgcacgggaactcggcgaccaacccggctccctgcggcgcctcgattacacgcaagcgcgcttcgagaactggagcccgctcgggctggtagtgcacatcaccccggcgaacgcgccaatgctggcgttctgtgcaatcatcgagagcctgctggccggcaacatcaactggctgcggcccagcagcagcgatcaaggcctgagtgcacgcttgctcaacgcactggtgcaatgcgatccaagcggtcagcttggtcattacctcgctgtgttgccggtgaccaccgcgcaaatcggtcaactgtgcaaacgggccaacggcgttgccgcatggggtggcgcagcggcgttgcaggccattcgtcaacacctgccttccgggtgccgctggatcgactggggacatcgcatcagtttcgtctacatgacgcccgattcgacctccgaaacagtgctggacgccatcgtcgacgaagtctgccgactcgatcaacaggcgtgctcgagcccccagtggttattggtcgacagtgacgagccggacgtgctcaagcacatcggcgcggcattggctgaagcattcggccggcgtgccgaacgctggccagtgttgttgccgacgctgcaggaggcttcggaaatcaccagccgtgtagcgatgacgcggctcggccagagtttttccgagctgaccgccgaagtctggagcgcacctggctggcgcgtgatctggactcacgatcaggcgctgagcccctccccgctgtttcgcacgctgctgctcaagccgctgccgcgttcacgcctggcacacgtcctgctggattggcgaaacgtgctgcagagctgtgcgctgatatgtccccaggcacagatcggcgaactgtcgcgcgccttgatagctgctggcgtcacgcgcattgcgccgatcaatgccattcatgacggttacgacggcgaaccccatgacggcgtgtatgcgctgcaacgcctgagccgccgcgtctcggtcagcttgccggcaaccttgctgacgactcacgcgacgctcgatccgcagcctgaggcatcaggtctgagcgacctgccgatcatggataaacaagccttcatcgatcggccggccaacgcggcagcgcagttgtatttccgttcgggaggcagcagtggcacgccgacattgtcaggcttcagtcatcgcgacttccagcgacaaatgcgtgcgaccgccgacggtttgttcgccgcaggcctcgatccacgctacgacagggtgatgaacctgttcttcagcggcggcctctacggcggttttttcagtttcgccaaagtgctggaattgctgggcgccacgcacctgccgatgggcgcaccggccgatgatgattacagcgagattgcccgactgatcgttgaacaacgtgtaacagtgttgatcggcatgccgagcaccctgcaccgcttgttcctcaacgagcagcaaacgttgcgcgactacgacgggatcgaaaaagtcttccttggcggtgaacacctcagtgagccctgccgtgagctgctgcaaagttgcggcgtcaagagcgtgcgttcggccgtttatggcagcgtcgatgccggtccgcttggccacgcctgcgccgcgacaggcgatggcatttttcatctgctgagcgatatccagtcgctggaaattgtcgcgctcaatgacgatgtgccggttgtcggcgacgaagtcggccgactgttattcagctcgaaagcgcgtgaaggccagccgatccagcgttatgacgtgggtgacagcggtcgctggctgtccggcccatgtgattgcggcctgacgtccccgcgtttcgaactattgcagcgacatggccggctggtgcgtatcggcaccgatttcatttgcctgaacaccttggccgagcatctgcaaaccgaatttcaattgctgatggcgcacgcgcctgacggcgttgaaagcctgctgtttcgcagttcccgcgagccggcggatgtgctcgaacgcctgcaaggctattccattctggcaaccctgctgcgcagcggactgctgaagctggaggtcgaggtctgcccaccggcgttattccaccgcaacaagcacagcggcaaaacccctttattgattgatgcgcgccgttgaagtgcagccaccgcacccggactggcgccattacttaaagagaacaccatgacagctgcaatagaactgaaccagttggtcggctttgctcgagcgcattcgaattattatcgcgaacatttacacaatgttccgtcctgtttgacgagcctctgtgaattaccgctgattgatccgcacacttactggcaatcaagccatgaccttgatcaatggccagtactgacaggcaacttcgccaaggcgctggtgttcaagaccggtggcactaccagcaacggcaaactgtcggtattcacccgcgacgaatggcagacactggtcagcgactttggcgttcagctcaccgcacaactgaatgacggcgaccgcattgccaatctgtttttcgtcggcgacctgtatgccagtttcgtgttcgtccacgatacgctcgcgcatacgggaagtgccgtcaccgaatttccgtttaccggaagcgtcgattctgcagtgttggccgattcgattgctcaataccggatcaacgttttagccggcgtaccggcgcacctgctgacgtttgccgcctggctggagcgccaatcgcgcacgctcgaaggtatcgacaccctgctttatggcggcgaaagcctgttcggcgggcaattgctgttgttgcgccgggtcttccccaacgcccgaatcgcctcgatcggttacgccagtgtcgacgctgggtttatcggtttcagcagccgtgactgtgccctggacgaacaccgcatgctcgagcgccacagtgtggtagaaattcttgatgaacagaccggtgaggtgatcgaggattgcgggcggaagggacgtctggtccttaccaatttcacgcgtcggctcatgccgctgattcgctatccggtgggcgacctcgcctgttggaaagaacctcatggcacaccgatgcgaaaattcgccctgatggggcgcagcatggacagccagcgtgtgcgggtgggcagcatgaccctgctgaccgcagaaatcggcgaaatcgtgcaacgcatcgctgccggaggcgaatggcaactggtgctcgatcattcgaatgatcgcgatgacttgcacctgaaatggcggcacgcggcgctgcacctcgacacggcgcaggtcaacgcagacctgcgcacggcgctgatcgatcgctacccgttgatcgaacaactgactgtcgatggattactcgatctgcaagtggtgagctgcgccggggaggatttcgcttgtcacccacgttccggcaaacaccagaaagtcgtcgacctgcgcatctatggcaatgcttatccggagccgcacgcatggacacagtgaccctgagaaactaccgcagcaccgatgctgtggccgtcagccgcctgttccgtgcagtctatggcgaccactacgttcaaccccacgtttatctgccctacatgatcagccagaaccacgacgatggccgttggcattcgctggtggccgtgagcggcaagaaaatcctcgggcacgcgacactgttcagaaatgccggctcgccgatcgccgaactggcgctgagcgtggttcatccagcgacacgcgggcaaaacattgccacgcggctggggcaacaattgttgatccatgcacaagcgctgggctgccgtggcgtgacgatcaaacaagtgacccatcacgcctactcgcaaaaaatggccgacaggctcgggtttcacagcacgggattgttacccgattacgcgccttcgccatttggcgaggtgctgccagagtcgatcgtcatgggtttcagagccatcgacgactacgagcggccgctgccatcgctcgattggccagccagctgcgccgatttcatgcagcagatgtgcaacgaatttggcacccgcaaaaccccatcaccctgggtcgggccaacgatgcatttcgaccaacgttcagggcgttatgacatggtgctcaaacagttgagcattgccgtgctccagcaactgcggcaattgccggctcactgggtggtttcgatcaggctcaggctggcagaaggatttgccggcgcattgcatagcctatcgatggcagggttcacattcaccggaattgtccccgatgatcgcagcgaaggttggctggcgctgtttcaccgggactacgtgccgcgccagttgcaattgcactgcgtgcgcatgcaacagttgcaggatcaaatacagcagcgcttcgccgattgctgcaatagcgaactgcaagctggctgaatgaaagaccggcaggcccgccaagagattgtgcgggcctttttccgtggtttttacgccttggctttgacgccactgtccacaggtttaggcatgttgccctcaccgtaggttttcaggttctgcaggacgtaaatcgctttcttgaactcgggaatcaggctcttgccgtaggcattgccattgagcccattggtctggatggcatcgagctgggtcgcgaaatactcaagcgcgttgaatttcgcatcgatatctttcgtcacgccaaaacgatcgaacttgtcgccagcgttctttagcgtaaaggaagtgatctcggagatcagcccgcggcctcgcaagagttcgctcagattgcccaattgcttaaccgaaacattggatggatcgaaacccttgatagccttgcgcaaaccctgcttgtccatttcggcagtattcagcgcggtggggttgttgcccaccatggtgagcatctgctgcaccttgacgctctgggacacttgtttttttgcgccggtgtcgcgtaccagaatccctgccttggcctgccagccgccgactataccgatcgtcatgagaagactccctgtgaaatgaccatgaaatgtccttgttgaacgcctctaatggccgcgagtatcagcgggcgaactgatggcaccaacttctttctgcatttttttacaaatcttgtacattcccgatacaaacagccccaatgccgacaaacgttgagccagaggggctgtgcctgtcgatggacaatcggcttttgacactgaccagcaggcaagcccgcttgaatgtatcgacgctgataccgaccagtcatcggccgccatctttttagtacgccagtgcctcaagcttcttgccggcgcgacgatacgctgggatacccgcactgtttaacgctttgccccctaacaagaatcgcagttcaaggaccggatccccatgcccgcattccgtaccattcaggctcgctacacgctgtttctggttctgtttatcctgctgttgtcggtgttgaccgtggtcggcatcagccaactggtcgcgcccaaactgcgtcataccgaagaacaagtcgtcctcaaccgcatcgccgaagtcgccgagcagattcagggcgagttgaacaaagtccaggcgcagcaacgcagcatcacccagaccatcccgctgctcgacagcgccgcgatcgatacggtgttgccggggttggtggatcaatacggcgagctgaaggtttttggtggcggcatctggcctctgccggggcagcgtgaagccgggcgcaacaaattcagtacgttctggcatcgcgatgcctcgggcaaattggcggttaacaccttctggaacagcgacgcggcgcccaactatttcgaccagagctggtacaagggcggcatggcgacaccgcgcggtcagtgcgcctgggccgccgcctacaaggacgatgccagcgccgaaccacgcaccaactgcgccatggccatccagaaaaacggtaatgcctggggcgtgtcgaccattgacgtcaccctcggcttcttcaacgatctggtggcgcgcaaggaaaaagacctcaacgccgaaatgctcatcgttgaagccgacggcaagatcatcagtaacagctcgcgcatcagcggccagatcgtgctgaagaacatcagcgaactggccggcacgtcgaccttcgccagccaggtcaaggccggcctgcagaatcgtgatcaggcgcaacgcgtcgagttcgacaacaacggcgaagccagcaccttctttatgcgcccgattgaaggcacgccgtggttcctcgccaccgccctgccaacgaaaatgctcactgcccaacgtgatgacgtcctcagcaccctgagcctgttgcaaatcccgctggtgatcctgctggtgctgttgcaggtctacgcgatccgccagttgatctcgcgcctgaaagcgttgaaagccaacatcgattcgctgtccagcggcgatgccgacctgacgcgacgcatcaccattcgcgccgaggatgaactgggcgccatcggccactcggtcaacacgtttatcgcttacctgcagaacatgatcggcgaagtcacccaggccaccggtgccatggcgtcgagcctcgacaatctgcaaagtacttcggcgcataccagccagatcctgctgcgtcacgcctcggaaaccgatcagaccgtcaccgccatcaccgaaatgagttcgacggcggaaagcgtcgcgcaaaacgccgccgagaccgcagcgttcacccagcgcgccaacgaaaacgccgaccgctcacgcgtggtggtgggtgaggcgacgagcagtgtggttgcgctgatcgacgaagtggccagcgctacacacaaagttgaaaacatgcagcaggacgcccaacgcattaccgagattctcggcgtaatcggggcgattgccggccagaccaacctgctcgcgctcaacgctgcgattgaagcggcccgtgccggtgagcagggccgaggcttcgccgtggttgccgacgaagtgcgcgccctcgccgctcgcacccaggccagcacttcggaaatcaacgagatgttgacgcgtctgacgcaaggcgtgagctcctcggtcagcgccatggaaaatacccaggcgagttgccagtcggcggcggatgccaccgcgcgcgtcaactcgggccttgatgaaatggccggctcggtcagccacatcaacagtctcagtacccagatcgctaccgccgccgaacagcaaagcgcagtgaccgaagagatcaaccgcagcatggtgcagatccgccacatggtcgatgaattggtgcagagcggtcaggccagcgaactcaacacccggcaactgctggaagccaacagccgggtgagtgcgatcatgggacgtttcaaagtccgctgattcatgcaggaactcctgccaaccctataacccctgtgggagcgagcctgctcgcgaaagcgtcctttcagtcactacttccagtgcctgacacacggccttcgcgagcaggctcgctcccacagggttcgacggcgttcacaccatcgccagatgtggccacctgacaactttgtcatctcgcgctcagcaacctgtcagccttgatctacgatcatcctgccagcccgcctcgcaacaactggaaacattgcgttgatgccagacgggaaaaaccggtcaaaatgcgttcttttctgatcgtcacccgagccgagaatccgtcatgcgaacccacctgcgtctggtcgccctgagcgccctgttcatctcctccctggcccaggcagccgatttgatccccatcgaagtccatcgcgacgccaattgcggctgctgcaaaaaatggatcagccacctcgaagccaacggcttcaaagtcgaagatcacgtcgaaagcgacatgagcagcttcaagcagcaacacggcgtaccaccgcgtctggcgtcctgtcacaccgcaatcatcaacggcaaattcgtcgaaggccacgtgccggctgaacaagtgctggccctgagcaagcgcaatgacctgctcggtgttgccgcaccgggcatgccgatgggttcgccgggcatggaaatggatggcatgagcgatgcctatcaagtgatcggcctgaaaaaggacggtgctgacgtggtggtggcggactacccggcccattgatcggcgcggcttatttcgggctgttcttcgccgcgttcggtgctgcgacattgttgccgctgcagtccgaggcgttgctggtcgggctgatcgtcagtgatcgttactggctctggggactgctcacggtcgcgacgctaggcaatgtgctcggctcgctggtcaattggtggctgggctgtcggctcgagcgatttcaggatcggcgctggtttccggtcagtcccgcgcacatggccaaggcgcgcaagcactatgagcgctacggccactggtcgttgctactgagctggctgccgatcatcggcgacccgctgacgctgatcgccggtgtcatgcgcgaaccgctcggacggtttctgtttatcgtaaccctggccaaaagcgcacgttacggcgtgctggccatgctgacgctggggtggctggggtgaacgatcgggcgcgggcattgcctgtgtttaacgtcgccataatccggccgttccagcatcggccgctttcaaacggagtttgaccttatgtctgtcacgttttcccgttggctcccctcactgctcctctgcgccgccctgcccttgtctgcgcaggctgccgcgccagccgaagcaatgcccgaaggcccggcttacggcccggaactgcaaggtttcgaatacccttacacgcttaaacactttgccttccagtctcagggcaaatccctgcagatgggctacatggacgtcgccgcgcatggcaaagccaatggccgcaccgtggtgctgatgcacggcaagaatttttgcgccgcgacctgggacagttcgatcaaggccctgagcgaggccggttaccgtgtagtcgcaccggatcagattggcttctgcacatcgagcaaaccggacaactatcaatacagcttccagcaactggcaaccaacacccagcaattgctcaaagcgctgggcattcagaaggccaccctgctcggccattccaccggcggcatgctcgccacccgttatgcgctgctgttcccggaacaggtcgagcaactggcgctggtcaacccgatcggcctggaagactggaaagccctcggcgtgccctatcgcaccgtggatcagtggtatcagcgcgagctgaaagtcagcgcccagggcattcgtgattacgaacgcaccacctattacgacggccgctggaaaccggaattcgatcgttgggtggacatgctcgccggcctcagcaaaggcccgggcaaaacccaggtcgcgtggaactcggcgctgatctacgacatgattttcacccagccggtgtactacgagttcaaggacctgaagatgccgaccttgctgctgatcggcacttccgacaccacggcaatcggcaaggatctcgccccaccggaagtaaaagccaaaatcggccattacgaggtgctcggcaaacaagtggccaagctgattccgcagtcgacgctggtggaatttcccggcatgggccacgcgccgcaaatggaagaaccggcgcagttccacaaagctctgctcgactggctgaatacatccaatcccgttcgttgatgaggtaaggctgatggcggtgcagattgcagtaatcgatgactggcaggacgtggcccgcgatgtggtcgactggtcagtgctcgatagcctcggtgaagtgacgtttgaacatgattacccggccgataacgccacactggccgagcgtctcggccggtatcaggtgatctgtgtgatgcgcgagcgcacgcgtttcgatgaagacctgctcaagcgtctgcccaatctcaagctgctggtcaccggcggcatgcgcaatgcggcgctggacatgccagcggcagccagactcggagtcaaggtctgtggcactgacagctacaaacatgcagcgccggaattgacctgggcactgatcatggccgccacgcgtaacctggtgaatgaagccaatgccctgcgcgccggcaagtggcagcaaggtctgggcggcgatctgcatggcaagacgctgggtattctcggtctgggcagtattggccagcgtgtcgcgcagtttggccaggtgttcggcatgcgggtgattgcctggagcgaaaacctcactgcagaacgagctgaacaagtgggcgtgacgtacgttaacaagcaggcactgttcgagcaggccgatgtgctttcggtgcacctggtgctcagcgagcgcagtcgtggtttggtcgatgcgcaggcgctgggctggatgaaaccgacggctctgctggtcaacaccgcgcgcgggccgattgtcgatgaagcggcgctgatcaaggccttgcagaaacagcagatcgccggggcggcgctggacgtattcgagcaggaaccgctgccggccatgcacccgtttcgcacactggacaacgtactggcgacgccgcatgtcgggtatgtcagccggcagaactatgcgcagttcttttcgcagatgatcgaggatattcaggcttgggcggctggggagccggttcgcctgttgaactgacccttttctgcaaatagagggtgaagtcaccattgctatcgcgagcaggctcactcctacaggggaacgcatttcaactgtaggagtgagcctgctcgcgatagcgtcataacagtcaccccatcaacaaactgaccgcaccacaacagtgcaaccgcactgaccactggcacaaaatcgtgaccgcccagtcaccgttttggccctctctcgcaaaaaaacctgcacttcgtcggtgcgtttgccccgccaaagtacggtttgcacagactgccaaccgattgtcgaacaatttacccatttgctctggcccgctctaggatctggcctagactggttttttcgaggtacgacctgccagtcacattgcggaaaaaaactcgaaacttttgcgcaaagcggcgggtcatctgaaaggcagggccaaagcgactggtgcaatccttgcaatggcctctacacccattctgcttgcgcgtgttgggtagcgtttgctcaccgatgcgtggcgcgtttgcgcccggccacaggatgtggccatggacatcacttgttccagacaagaatcagatcaacaaaacgggagttacatatgatcagtgcggcattagatattcagggagagcgtgctcagcagtcagttggcgaatcgagcagcgtcagtgttcccggcagccgacagatcaacgtccccggcaccaagacgctgactccggtagcgagccagaatccgaacaaaaagaaagtgctgttcgtgacttcggaaatcgccgatctggtgaaaaccggtggcctgggtgacgtctccgccgccctgccccgcgccatggcgcatctgcacgatgtgcgcgtgctgatccccggttacccgcaggtaatgcacagcgagaacccgatccacatcatcggcgaactcggtggccacgctgcgctgccgccgtgcaagatcggccgtatggacatgccggacggtctggtgatctacgtgttgatctgccccgaactctacgagcgcgaaggctcgccctacggcgccaacaacggtcgtgactggccggacaaccacattcgtttcgcccgtttgggtctggccgctgccgatatcgccgccaacctcgcacaaattcactggtgcccggatctggtgcacgcccatgactggccggccggcctggcccctgcctatatgcactggcgcgggcagcgcacgccgaccctgttcaccattcacaacctcgcgtatcaaggcgtgaccagtctcggctcctgccctgagttgggcattcccaaccatgccctgcaacaggaaggcatggagttctacggcaagatgtcgtttctcaaggccggcatggcctattcgagccatatcaccacggtcagcgcgacttatgcgcaggaaatcaccaccccggatttcggctgcggcctcgacggttttctcgccgccaagacccagcaaggcttgctcagcggtatccccaacggcatcgacgagagctgggacgccgccaccgatccgcacctgttcgcgccgtttgccatcggtgactgggaaggtaaagcggtcaacgctgcgcatgtgcgcgaactattcgaattgaatgactccgaaggcccgttgttcgccgtggtgtcgcgactggtctatcaaaaaggtctggacctgacgatcgcggtgtccgagtacatcgttgaaaacggtggccagatcgcgatcatcggtcgcggcgagccggaagaagagcaagccatgcgtgaactggcgctgcgctttcccgggcagatcggcgtgcgcatcggcttcaatgaaaccgacgcccgccgcatgttcgccggcagcgatttcctgctgatgccatcgcgttacgagccgtgtggtttgagccagatgtacgcccagcgcttcggctcgctgccggtggcgcgcaacaccggcgggctggccgacaccattgaaaacggcgtcaccggcttcctctttgaccaatccactgctgagagctatcaagaagccctgagccgtgcgttcaaggtcttcgcctttccagagctgctcaatgccatgcgttgccgggcgatggcggcacctttcaactggtgcaaagcggttgaaccgtacgccgaactctacgagcaactggtggccaaggcactgggtaaagcgcaccacaaataaccagggaggttttcaacgatgccgttacggtctactgaaacctggccccacggcgcgatcatgctggacgccgaacacacgcagtttgcactgtgggcgccggatgcgttttacgtcagtgtcgagctggacaacggccagtccctgccaatgctgcctcaggcagatggctggttcgtgatcaagacccgctgtgcggcgggttcgcgttatcgctataacatcgacggtgaactggaggtgcccgacccggcttccagggcgcaggacggcgacctcgaccgtcacagcgtggtggtcgatccgctggcttatcaatggcgacacacggcctggcacggtcggccgtggagcgaagcggtgatctacgagttgcacgtcggtgcgctcgggggattcgcggaagtcgaacaacatctggcgcgccttgcgggcctgggcatcaccgccatcgaactgatgccgctggcgcagttccccggcgaacgcaattggggctacgacggtgttttgccctacgccccgcaagcctcctacggcactccggaacaactcaaacaccttatcgacagcgcccacggccacggcctggcggtgattctcgatgtggtctacaaccacttcggccccgacggcaattacctccatcgttacgccaaaggttttttccgcgaggacaaacacacgccgtggggcgcggcgatcgattttcgtcgcgacgaagtgcgcgagttcttcatcgaaaacgccctgatgtggttgctcgaataccgcttcgacggtctgcgcctggacgcggtgcatgccatcgaagacccggatttcctcacggtaatggcccagcgcatccgcgcgcagatcgacccgagccggcatgtctggctgaccgtggaaaacgaactgaaccagtcgagcctattggagtacgactacgacgcgcagtggaacgacgacggccataacgccctgcacgtgctgctcaccggcgaaaccgacgcctactacgccgactatgccgcacaacccaccgaacaattggcgcgctgcctcagtcaggggtttgtcttccaggggcacatcacccgccatggcgaaccgcgcggcgagcccagcgagcacctgccctccacggcgttcgtgctgttcctgcaaaaccacgatcagatcggtaaccgtgcgttcggcgagcgcctgcatcatctggccgatccgcgcgccgttcaggcagcgaccgtgttgttgctgctgtcaccgatgattccgctgatgttcatgggtgacgagttcgccgccgagcagccattcctgtttttcaccagtcaccacggcgaactggcggaacgggtgcgcgagggtcggcgcaatgaattcgccgcgttcagcgccttcgccgatccgcacaagcgcgagcagattcccgacccgaacggcgaaaaaaccttccacgcttcacagccaaggttgatcggtcatggcagcgaaaaacagcaggaaaccctcgcgctctaccaaaagctcctgcaatttcgccatcaatacatcattccccatctgtccggcacgcaagcgctcggcgcgcatatgctcggttatggcgcggtcagtgcgcgctggcgtctgggcaatggcagcgagctgcgaattgacctgaacctcagcgacacgccagtggtcaaccctccacagaccgaggccgtgtggttgtttcaacagccacccaccgtcgatctatcggaatcgggcgtactgcccgcgtattgcgcgcttgtcagcctcacggccgcaacccctttgcaacctctgaatggagagcgcctatgagcgatgcgcaactggaaattcttgcaagccgcgccggccttgccgtcgactggatcgacgccaacggccgcccgcaaaaagtcgctccggcggtgctgcgcaatgtcctgatcggcctcggtcaccccgccagcacggcgcaggaaatcgacgccagcctgttggaactgcaagccgttcaacaagatcgccacttgccgccgttgttgaccgccgatgtcggtgtcggcgtcgatctggcgcgttatttcgccccgcaaacgccgtgtgaaatccaccttgaagacggctcgcggctgaatctgaaactcgattccgaagcgatattgccggggctgatcccggtcggctatcaacaggtgcacatcagcgatcagtatttcaccttggccgtggccccggagcgctgcttcagcgtcggcgatgcagtggataatccgattccccgcgtctggggtctgagtgcgcagctgtattcgctgcgccgccccggtgacggcggattcggcgatactcaggcgctggaagacctggtgcgcgtggccggtgaacgcggcgccgatgcggtggcgatcagcccgctgcacgccatgttcaacgccgataacggacgctacagcccttattcgccatccagtcggttgttcctcaattctctttacgcagcacccggggccattctcggtgagcgcgccttgcgtgatgcgatcgacgcggccggcctggccgagcagttcgcgcaactggaagacctgacgctgatcgactggccgagcgccgccgacgccaagcagaaacttctgcaagcgttgtatgaaggtttcatcgccggtgagcatccgctgcacccggacttcgccagtttccgtcacgccggtggcgaagcattggaaaaccactgccgtttcgaagcgattcaggaaatgcgcgccgcccgtggcgagaacctcgactggcggcaatggccggaacactggcacgacccacgcggcgcggcgctcgaagccttcgccgaagaatatgccgagcgcatcggctatttcgctttttgccaatggctgatccaccgctgcctggaacgtgcgcaaaccgccgcacgcagcgccggcatgggcattggtctgatcgccgatctggcggtcggggccgatggtgccggcagccaggcctggagctttcaggacgaactactcgcctcgctgaccgtcggtgcgccgcccgatatcctcaaccgctccggtcagggctggggaatttccgcgttctcccccgaaggcctgatccgtaatggctttcgcgcgttcatcgacatgctccgggccaatttcgcccacgctgggggcttgcgcatcgaccatgtgatgggcctgcaacgcctgtgggtgattcccaatggcgcggtgccggccgacggcgcctatttgtactacccggtggatgatctactgcggctgctgaccctcgaatcccatcgtcatcaggcgattgtcctcggtgaggacctcggcaccgtgcccgacggcctgcgcgagaaactcatcgcccgctcgatgctcggcatgcgtgtgctgctgttcgaacaggacaactgtcacttcaagcccatcctcgactggccggacaacgccctcgccaccaccagcacccacgacctgccaacactcaatggctggtggcatggccgcgacatcgactggaacgcgcgcctggattttgtcgatgccaacggtgaaatcgaatggcgccatcatcgccagcgtgagcgcgaaggtttgcgcagcgccttgagccaggatccgcaaaactttcgcgaggaatcccacgaggccgatcaagtagtcgatgccgctgtgcgcttccttggccatacccgcgcccccttggtgttgctgccactggaagacgcgctgggtatcaacgaacaggcgaacctgcccggtaccatcgacacacacccgaactggtcgcggcgcttgcccggtaccagcgaagcgttgctcgatagcgacgacgctgcgcgacggcttgagttactggcgtgcgcgcgccttcaggcggccgagcgtgaccaatgaaccaagcgctcatccagccactgcgcgcgacgttgcgtctgcagtttcataaaggcttcaccctcgaacaagcggtgccactggtgccgtactttgcccggctcggcatcagccacatttatgcctcgccgctactcgccgcgcgtgccggctcgatgcacggctacgacgtggtcgatccgacccaggtcaacccggagctcggcggcgaagcggcgttgcggcgtttggtcagcaccctgcgcgaacacaacatggggctgatcctcgatattgtctccaatcacatggccgtcggcggcagcgacaatccgtggtggctcgacctgttggagtgggggcggctgagcccttatggcgagttcttcgacattcagtggcactcgcccgacccgttaatggaaggccagttgttgctgccgtttcttggcagcgattacggggtcgcgttgcaggaaggcacgctgaaactgcgtttcaatgcgcagacaggcagtttccatgtcgagcattatgatcatcacttcccgatctgcccgaacgattacggcgagttgctgaagcccgcggaagcgctgaaacccctcgcggatcgcttcagcacgctgagttaccagaccgatgcgcatgcgctggcgatcccgctgaaggacgagttgcggcaactggcgcgcgacccgcagatccttgccgcgattcagcgcaaccttgagcatttcgactcgaccacggcagaaggcttccagcagttgcatcaattgctcgaacggcaaagctatcgcctcgccagttggcgcaccgcagcggatgacatcaactggcggcgcttcttcgacatcaacgagctcggcggcctgcgcgtcgaacgtccggcggtgttcgaagccacccacggcaagatcttccagttgatcgccgaagggctggtcggcggtttgcgcatcgaccacatcgacggcctcgccgacccgcgcggctactgccgcaaactgcgccggcgcgtcgatcggctggcaccgggcaggcacttgccgatctacgtcgagaagatcctcggcgccggtgaaaccccgcgccgcgactggacggtggatggcaccaccggttacgagttcatgaatcaactatcgctgctgcaacacgatccggacggcgaatacgtcctcggtgatctctggcaacgccgcaccgaacgctccgccgcgttcatcgaagaagcgcaactggcgcgtcagcagatcctcaacggctcgctcgccagtgactgcgaaagcgtcgctcaggccctgctgcaagtcgcccgcgatgacctgatgacccgcgacctgacgctgggcgcgatccgccgggtgttgcaggcattgatcgtgcacttcccggtgtatcgcacttacatcagcgccatgggccgctcggcgcaggacgaggggtttttccagcaggccatggacggtgcccggcaaaccctcagcgaaggcgactggccggtgctcgactgcgtggcgagttggctcggtggcacaccgtggcggcgcaaaccgcgcggccgctcgcgcaagattctcaagcatgcctgcgtacgctttcagcaactgacctcaccggcagcggccaaagccgtggaggacaccgcgctgtatcgctcggccgtgctgctgtcgcgtaacgatgtcggctacaacaccgagcagttcagcgcgccggtcagcgactttcatgcggtcaatcagcaacggttggatgaatttcccgacaacctgctggccaccgccacccacgaccataaacgcggcgcagacacccgtgcgcggctggccgtgctcagcgagcgcagccattggtacgcggagcagatcgaattgtggcgcgccctcgcccgcccgttgcgggttgacgagcaaatgccgtcgagcggcgatgaactgatcctctatcaagccttgctcggcagttggccgctgcaactgcgcgatgacgatcaggccgggttcgccgactacgccaaacgtatctggcaatggcagcagaaagccctgcgtgaagccaagctgcaaagcagttggagtgcgccgaacgaagcctatgaaaacgccgcgcaagcgttcaccgaaaaactccttaccggagaggaaggtgaactgctgcgcgccgcgctgagcaagaccgtcaacagcatcgccgctgccggcgcgctcaatggtttggcgcaaaccttgctgcgcatgaccgtgccgggggtgccggatctgtatcagggcaacgagttctgggatttcagcctggtcgatccggacaaccgtcggccggtggattacgccgctcgtgagcgagccttgcaggagccattgccacctgtggagttgctggcgaactggcgtgacgggcgtatcaaacaagctttgatcgcccaggtgctgaacctgcgcgtcgagcatgccgagctgtttcggcgtggcagctaccaagccctggaagtgctcggcagtcaggcgcacaacgtgctcgcgtttgcccgcgagcacgaggggaagcaggccatcgtgatcgtgccgatccgttgcgccacgctgctggaaaacggtgctgtacctcaggtcgatgcgctgcgctggggcgatacgcgggtggttttaccgttcgccgcctctgacacaaacctgaagggacttttttcaagcagcgcagtcacaaaaaacagggagctgaatatcagcgacgcgctgggggatgtcccggtcaatctctttatccaacacttaacgtaagcatgagttcagttcaggagcattgcgatgagtaccgacgataaacgcattcgcgaattcgcctatcagatatgggaatcggaaggtcagcccgacggtcaggaagaacgccactgggagatggcgcgcaaactggccgaagccgaggcgttggccccgaaaaagccaccgaaagcggctggcagcaaaaccgctggcaagactgccgaaaccaaggcgccggccaccaaaccgaaacctgcgttgaaagccaagcccgccagcgccgccaaagtgattcccccgggcgaaaaagccgccgagaaaaagccccgagcgccgcgcaagccttcggcgatctaaagctttaacgacgattgaactgaatgaccgtgtggcgggctcgctcgccaccgaggacgcgttcgtcctcaagaaacccaccaatcccctgtaggagtgagcctgctcgcgatagccatttgacattcgacatcgatgtcgcctgatagaccgctatcgcgagcaggctcactcctgcacggagatgtgtaagcccagaaattacccgttttgcaggagcaatcatgacccgtccaaacaaacccgagcccaccgcgcacgccgagccgtcgagaatccgtgaaggcctgcccttcccgctcggtgcgacctgggatgggttgggggtcaacttcgcgctgttttccgccaacgccaccaaagtcgaactgtgcatcttcgacgatgccggcgaagtcgaactcgaacgcatcgaactgccggaatacaccgacgagatctaccacggctacttgcccgatgcgcacccggggctgatctacggctaccgtgtctacggcccgtacgacccggccaacggccaccgattcaaccacaacaagttgctcatcgacccctacgccaaacaattggtcggccagctcaaatggtccgaggcactgtttggctacaccatcggccatcccgatgccgacctgagtttcgatgaacgcgacagcgcgcctttcgtgcccaaatgcaaagtcatcgaccccgcacacacctggggcaacgaccagcgtgtcagtgtgccgtgggacaaaaccatcatttacgaaacccacgtgcgcggcatcagcatgcgtcacccctcggtgccggaaaacgtgcgcggcacctttgccggtctgatgaatgacgatgtactcaaacacattcgcagcgtcggcgtttcgtcggtcgagttgctgccgatccacgccttcgtcaacgaccagcatctgctgcacaaaggcatgaccaattactggggctacaacagcatcgcgttctttgcccccgacccgcgctacctggccagcggcaaaatcgccgagttcaaggaaatggtcgcgcacctgcacgaagccaacctcgaagtgattctcgacgtggtctacaaccacaccgccgagggcaacgagcaaggcccgaccctgtcgatgcgcggcatcgacaacgcctcctactaccgcttgatgcccgacgacaagcgcttctatatcaacgattccggcactggcaacacgctggatctgagccacccgtgcgtgctgcaaatggtcaccgactcgctgcgttactgggccacggaaatgcacgtcgacggtttccgcttcgacctggcgacgattctcggccgttatcacgatggctttgacgaacgtcacagcttcctcgtggcctgccgtcaggacccggtgctgcgtcaggtgaaaatgatcgccgagccgtgggactgtggccccggtggctatcaggtcggcaacttcccgccgggctgggtcgagtggaacgacaaattccgcgacaccgtgcgcgcgttctggaaaggtgatgacggtcaggttgcagacttcgccagtcgcatgaccgcctccggcgagatgttcaatcagcgcggacgccggccgtattcgtcggtgaacttcatcaccgcgcacgatggtttcaccctcaacgatctggtttcgtacaacgacaagcacaacgaagccaacgacgagaacaatcaggacggcagcaacaacaatctatcgtggaaccacggcgtcgaagggccgaccgacgatcccgagatcaacgcgctgcgccatcggcagatgcgcaatttcttcgccaccctgctgctctctcagggcacaccgatgattgtcgccggcgatgaattcgcccgcacccaggacggcaacaacaacgcctattgccaggacagcgagatcggttgggtcaactgggacctgagcgaggatggcaaggcgctgctgaaattcgtcaaacgtctgatcaagttgcgactggcctatccgatcctccgtcgtggccgttttctggtgggcgaatacaacgaagacatcggcgtcaaggacgtcacctggctggcgccggacgccactgagatgaccaccgagcattggcatgacgcacacaatcgctgtctcggcatgttgctcgatggtcgcgcgcaggaaaccgggattcgccgcaaaggtggcgacgcgacgctgctgctggtggtcaacgcgcaccacgacatcgtcaatttcaccttgccgcaagtgcctgacggcggtttctggacgtgcatgatcgacaccaatcagccgtcgattcgcggtcaggaacgtttcgatttcggtcatgaatattccgtcaccgggcgctcactgctgctgttcgagctgcaacacgaagaagaagattgatatggacttgcacagctatctcgcccggcgcccgccggactacgccaataccaccgccctcggcagttgcctgcgggcgatggtcgaggccgggcatgaccgtttgccgctacccggcagcggtcgcaccctggaacgttttcagcacttggccgatgtcggcgggcatgatctgggcctgtgcaaactcttcgaggggcacaccgacgcactggcgatcatcgagcaactgggcggttcgccgacgcccggcagtacgtggggcatgtgggctgcggagccgccgcaggctcgggtcaaggtttcggcggccgggcacatggtcgcgctgcacgggcgcaaagcctggtgttctggcgcggcggtactcagccatgccctgctgaccgcgtgggacgctgacgatcagcaacaactggtcgccgtcgccctcgatcaaccgggcgtgaccatcaccgatcagggttggcaagcggtgggcatggcggcgaccggcagcgtcgaagtggtgttcgaaggcgccgaagcacaggcgatcggcaaccctggcgactatctgcaacgcccggggttctggcaaggcgggatcggcatcgctgcctgctggtacggcgccgcacggcagcttggcgaaagtctgcgccaacactgcgcgcgacgcgaagaagcccacgccctcgctcatctcggcgcggtcgacacggctttgcaggctggcgctgacgtcttgcgcttcagcgcactgcacatcgatgcccatcccgaggacgacgccgaattgctcgcgcgtcgggcccgcgcggtggtcgagcaatcggccgaacaggtgatgcgcgaagtgggccgggccctgggtgccgggccgttttgcaaagaccggcatttcgcccggttgatcgccgatctgccggtgtttctgcggcaaagccacgccgaacgcgatctcgccgccctcggccaactgatcaccgcgcaatcggatgaggtatggacgctatgagaaccaatccaatcgtcggccagggaacatccctgcatcaatggcaaagctcacgacatctggcggagctcgacagcatcgacatccttagtctggtgccgcctggctcacgcgcggtgattgtcgcgccgcatccagacgatgaagtgctcggctgcggcggttttctgcaacggcttgccgctgccgggcgtgagctgcaactgatctcggtcaccgatggcagtgccagccatcccggctccgcgcgctggccggtggcacgcctgagcgtggtacgtgcgcaggagtccgccgaggccctgcgccgactcggcctgccgatgcatcgtttgaagtggctgcgcgcgggtttcactgacacacaggtggccgctgaagaacccgccttgcgcgccttcatccagcggcatctgcgcgccaacgatgtgctcttcaccacctggagcgaagacggccattgcgaccatgaagccgtcggccgcgccagtaccgaagcggcgcggcttgtcggtgcgacctgccacgaactgccggtatggacctggcactgggcaacgccggaagacgctttggtgccatggcagcgggcacgcaagattctcctgtctcccgagcagatcgcgcgcaagcgtcacgccgtgcacgctttcgccagccaattggagggcgacgccgaatccggactggcgcctgtgcttgcgccttacgtgttggaccggctgctgcaaccgttcgaagtggtgttcttgtgagcgtcgaagaccgctatttcgaagggctgtttgccggcaacgacgatccgtgggcgtttcgccagcgctggtacgagcagcgcaaacgcgcaatcactctcgccgccctgccgcgtgcgcactatcgggcgattttcgaaccgggctgcgccaatggtgaattgagcgccgagttggcaggccgttgcgaccgtctgctgtgttgcgacacggcgagtgcggccgtcagtctggcgcgtacccgattaagcctgttcgatcacgccgaagtccggcaaaaccgcttgccggacgactggccggaggaaaaattcgacctgatcgtatttagcgaaatcggctactacctcgacagcaaggatctgacagaagtgatccgtcggatcagtcacagcctgaccgctgacggtcaattgctcgcctgccactggcggccgccgatcgatgactgcccgctgaatgcgcgacaggtacacgacctgatccacgaacaattgcatctgccgcgactggcgctgcatcaggaagccgatttcattcttgaggtgtggagccgcgagccacgttcagtggcggcactggagggtttgcgatgatcggcatcctgatcccggcgcacaacgaagaggcgctgctcgacgattgcctgagcgcggcgatgcgcgccagcaggcacggactgctggctggtgagcgggtcgaggtgttggtggtgctcgacagttgcaccgatcgctcggcgcagattgtcagccgttacccggtgcagagcctgcacattgaggcgcgcaatgtcggtcaggcgcgtgccgccggggcgcaggttctgctggagcgcggtgcccgctggatctcctgctcggatgccgacagtcgcgtggccgacgattggctggtggcgcaactgggcttgggggcagacgcggtgtgtggcaccgtgacggtcgaacactggcctgagtcgttcgccgaagccgcgcaaattcgctatcacagccagtatcaggcccgcgatgaccatcggcacatccacggtgccaacctcggcatcagcgccgacgcctatcgctgggccggaggcttcccgccgctggtgtgcgatgaagatgtgcagttggtccggcaactgcaattgtccggtgccgacatcgcctggagccatcgcccgcgagtgcataccagcgcccgcctcgacagccgcgcccgtggcggatttggcgactacctgcgaaatctggcacagctttgacaaataaatccggatcagattgatctgtaacgcgacgaactgtacttcatgagcaatactctgctgcgcggcaatccagggttcggagcgtcgcatggcatttaccccgccttcacgggtcgttcgcgacaaccatcgaggttgcaagcacgactgagggccagactcaacaaggacgtcattccccatgaaaccgttatttctcagcgaaaacagcccgaacgggcagatctggaacagcgccgcgcaactcgacaatattccggtcatcgccacccaaagcctggttccccctggggcgcgcgccgtggtgatcgccccgcatcccggcgatgaagtggtgacttgcggcggccttctgcaattgctcgccagcctcggccatccgttgcaactgctgtcgatcaccgacggcagcgccagccaccccggttcacgtcaatggtcggagaaacgcctgagcgtgttccgtccgcaggaaagtgtcgaagccctgcggcgcctgggcttgcccatgcacagtttgaagtgggtacgcggtggtttcaccgataacgcgctgctggatcaggaacgccagctgaccgacttcatcggccgctacctgcgccccggcgacgtggtgttcagtacctggcgcgaggacagcaatgacgaccatgaagtcgtcggccgcgccagtgccaaggctgccgagctggctggcgccagctatcacgacgtgccggtctgggcctggcactggccggaacgcgatcacgcgctgatcccctggcagcgcgcgcgcaagctgcgcctcgacacctggaccgtcgcccgcaagagccacgccacccatgcttatgccagccagctcaagggtgagccggccatcggcatcgcgccaatgttgccgccggtgattcttgagaggatgcgtttgccctacgaaatcgtcttcgtctgacaagtaccttggaggagctgccgaaggctgcgatcttttgatcttgatctgcagaagcagaagcaaaagatcgcagcctcgtttcactcgacagcttctacagatgaatggcgcccccaagcaaaaggaactgccgcccctccccatcagtcgcatgaataagccgaccgctatccagaggagtcaccgtgtccagcgatcccgagcgtcatgtagtcgacgcgcccgtcatccatcgtctcagggtgctgacggtcaacacccacaaaggttttaccgcgctgaatcggcgcttcatccttccggaactgcgtgaagcggtgcgcagtacctcggccgatctggtgttcttgcaggaagtggtcggtgaacacgagcgtcattccagccgctacaacgaatggccgcaaacctcgcagtacgagtttctcgccgacagcatgtggagcgatttcgcctacggacgcaatgccgtctaccccgacggccaccacggcaatgcgctgttgtcgaaatacccgatccgtgaataccgcaacctcgatgtctcgatcaccggacccgaacggcgcggcctgttgcactgcgtgctggatgtaccggggcatgccgaagtgcatgcgatctgcgtgcatttaagcctgctcgaaagtcatcggcaattgcagctgcagctgctttgccaactgctcgaatcgctgcccgacgacgcccctgtgatcattgccggtgacttcaacgactggcaacttcagggcaacgtcgccctcgcccgtcgcgactatctgcacgaggccttcgagcggcatcacgggcgcccggccaagacttatccggcacgctttccactgttgcgactggaccgtatctacctgcgcaatgccagcagtcatgatccccggatcctcggcaacaagccgtggacgcatctctccgatcacttgccgctggcggtggaagtgcatttgtaagcgcgattctgacaagaccgtctgtcagccccgcttgaaccgcgaggaaaaccatctacacctaaatcagctcagggagtagcgcattcaatctcttaggtcatggagttgatgtaaggcatcagctgtaaacgatgccggacccatggcatacccaaggatgaattccccccgaatttgccgtagggaatgaccatgccgcgctactccacgcctctgcggacactaccgcacgttttgttcctgcccgcttccttgctgttattgatcctccaacccgtttcagcggcctgcacgcttgtgccggggcctggcaatgacaacttcacctgtgacagcggcaccagcagttcactgacggatctcgccggcaataacagcctgaccctccccgccaacagcactggccagatcaatggcggcgtaactttcggcgcaggtgccgaccgggtcgagatcaattccggcgtgatcaccggcgcggtcagtcagggcaacggcgtcgatgatttcgtcatcaatggcgggtctatcggttcactggcccaaggcgatagccgcgatacgttcctgatgaccggcggcaccatcgtcggcgctttcgaggacggtgatgtcgcacgcatgaccggcggcacgatcggccgggtcgacatgaaactcgataacaatattttcaacctgtcgggcgggcagattctcggcaatctggtgaccgggttcggcaccgatacgatcatcgtttccggcggccgcatcggcggcaacatcagtgtcagcggcggtaacgacagcatcaccgtcagtggtggggaaatcgtcggcgagattcgcgccagcgtcggtgatgacgctttcatgtgggacggcggcgggattatccgctcggcgattctgatggacatcggcaatgacacggccaccctgcgtaatctggacgacagcattcttgcgctgacgcccagcattgatggcggcgtcggtaccgatacgttgacactggacaacacgcgcaccgccctgcctgtgcgccttatcaattgggaaacggtcaacctgagcaatgcctcgcagcttgatctgggttcgtccagcctggtgctgggtgacgcgggaaccggcacgggcgcgttgaacatcgacgccagcagcacactgttttccactcagggcagcgttgcgccagcgctggcgggacaaaacgtgacgctcaacaacgccgggatcatcgacctgacacaaggcaacagccgcaccaacgacacactgaccgtgcaaggcaactacgtcggtaatcgtggtcagttactgctgcaaagcaccgttgctggtgatgattcggcaagcgacagactgatcgtcaacaacggcagccttggcgggtcgacggtcatcagtgtcagcaacgtcggcggtctgggcgcactgactcaggtcaatggcattgaactggtgcaggcacaaggcagcgctgtcagcagcaatacggcgtttactctcagcggcccggtgtctgccggcgcttacgattactacctgttcaaggggggcgtcaccgccggcaccgagaataactggtatctgcgctcagccgttgtcgcaccgcaattgatgagcgtgcccaatcccgatccggcattaccgccgcttctggttccagtcgtggccacgcccattgcggcggccatcaccccgctcgacggcgcgcccggcgaagcgctgtccatcgcctcgctgccggtgttacctgccgccgtggccggtgccgcgccaattcccctgtatcgcccggaagtaccgacctggtcggtgttgccgcccgctgccgcgcaactgacgctgaatgcactgggaacgtttcatgatcgtcagggcgagcagcgcctgctcagcgaaaccggcgcatttggcgccggttggggccgggtctacggcaagaacctcgagcagacctgggccggtacggtgactccgcgtctggacggctcactcaatggctttcaggtcggcaacgatctgttcagttcgcagaattccagtggccagcaccagcgcgtggggttctttgtcggccacagccgtttgcagggtgatgtcgacggtttcaacgagggcttccagcacaacagcgctggcaagatcaaactcgaaggcgacagctatggcctgtactggacgctcacggatccctacggctggtacgtcgacaccgtggtgatgggcacgcgtttcgacggcgacaaccattccgatcgcggggtaaaactggacaatcgtgggcacgcgctgaccttgtcggccgaagccggttatccattgccgatcagtgatacgtgggtaatcgagccacaggcgcaggtcatccaccagaaaatctccctcgacagccaggacgatggtatttcacgcgtctcgttcgattccgacggtgcctggaccggtcgtctcggtgcgcgcctcaagggtcgttatcaagtcagcggtttgccggtggaaccgtacctgcgcgccaatctatggcatacgttttccggaactgactcggtgacattcggcgccagcgatgtcattaccaccgaacagaaatcctcgacagcagacattggcctgggcgtcgtgttaaccctcgatcgcgccgtcagtgtgtacgccagtaccgattacaccagcaatattgacagcaatgacctgcgcggcgtggtaggcaatctgggtgtgcggattagctggtagaccttccgtcggcaattaaacctctctacctcggggctttcactgcgttttaccatgcaaacaacaacttagttatgtgcagaaaaacaaacgcttgcaaacactgctttaccactaccgctcatcgttcaatttcttgacgggcgccttccagtcttcttatctctaccttactacccccggaatcactacccgggacgagccttcggacactcgcgaaatcgagcggtcagggttcgccccgctccattcggtcgcccctcgttcggggtaggagagacgccaaactcgagataccgcatgcgcctgcaaggtagacctccatgaaaacgcccaccatcaccccacacgagatcaaaatcactttctgcacagtgtcgagttcgatcctgctgtgctcatccatggaggcgcaggccagccctgtgtcggatgaaacgaccccgtggtatcgcgcggacgttcccgtcatgaccttgcccgccacggtcattaccccaggcccgcaacgcctcagtccacgtccagacctgcagggcacgcgcctgatcaccgaagacctcgcaccgtcggcctgggatgagctatatggcagaagtgcccgtcaggcacaaaccgatgtgttgtcgtcgggttacgcgatgcctggcagcggcgacttcaaaggcccggctgtgttgactctgcaaagtggtagccatacccagaaaatcggcctgattggcggtctcaaccagattcaagccaatggcaatggtccgcttaccagccgcgccctggcagacccgaacagcgacaccctcaatctgcaaggccaaagcctcggcgcctattacagcctgatcggcgcccagggctggcacgtggatttatccgccagcggcggccgggtcagtggctttagccgcaacggccaaggcgcgcggcaagccaccgaaggcagcgccatgactttttcggtcgaaggcggttatccgatcggcctgagtgaaaactgggtggtcgaaccgcaggcgcaactgatcaatcaacgcatcaccctcgacacgccctacgccggctcgggcaatgcctcttccgccgatctgacggcatggagcggtcgtgtcggcgcacgcttgaaaggcagttacgatttgaacggcctgccggtcgagccctatgtgcgcaccaacctctggcacacggtgtacaccggcaataccgtgacactggatcaggtcgacaagatcagcagcagccgcaagtcatctaccgttgaattgggcttgggcctggtggcgcgggtgacgccggcagtgagtctgtatgtcagtgccgattacagcagtgatgtcgatgacaatgatttgaacgggatcattggcagtcttggggtgcggatgcgttggtagcgtttggcttggcggcgagagtgtttgtgctgacgccatcgcgagcaggctcactcctacaaggggaacgcattccaagtgtaggagtgagcctgctcgcgatggcagcaactcgctactggatcaaccctccggtttgaggatcagcaccgccagcggcggcaggttcaattccagcgacaacgactggccatggctcgccacttcctcggtaaatgccccgccgccattgccgtaattggaaccggcataggtgtcggcatcgctattgagcaactcagtccagcgcccggcaaatggcacaccgacgcgatacgcctgacgcggcaccggggtgaagttggccaccaccagcaccggtgcgccctccttgctccagcgcagccaggcataaacgctgttgatcgcatcgtcaccaatcaaccactgaaacccctgcggcgcgtcgtcctgatcgtgcaacgccggctcctcgcgatacagccgattgagatcgccaaccagtttctgcacgcctttgtgctcggagtactgcagcagataccaatcgagctgctgatcgtgattccactcgcgccactggccaaattcgcagcccatgaacaacagtttcttgcccgggtgggtccacatgaaactcaggtaagcacgcaggttggcgaatttctgccagcggtcgccgggcatcttgtcgatcagcgaatgcttgccatgtaccacttcatcgtgggagatcggcaggatgaaacgctcggaccaagcgtagaccaggccaaaactcaactcgttgtgatggtgggcgcggtacaccgggtcctgctgaatgtaatgcagtgaatcgtgcatccagcccatgttccatttgtaggcaaaacccaagccgccctgctgcgtactttgactgacaccgggccacgccgtggattcttcggcgatcaccagcgcgcccggcgcttccagctcaaccacatcgttcaaatgccggaggaaatcgatggcttcgagattctcgcgtccgccatggcggttcggtacccactcgccagccttgcgcgaatagtcgcgatagagcatcgacgccaccgcatcgacgcgcaaaccatcgacatggaaatgcttcagccagtgcagcccggaggcgagcatgtagccgtgcacctcggtgcgccccaggttgtagatcagcgtgtcccaatcctgatggaaaccttccagcggattgccgtactcgtacagcgcggtgccgtcgaattgcgccagaccgtgggtatcggtggggaaatgcgccggtacccaatcgaggatcacgccgatctccgcgcggtggcaggcgtcgacaaattcagcgaactgcgccggcgaaccgtaccgcgcactcggggcgaattgcgacagcaactgataaccccaggaaccaccgaatgggtgttccatgattggcatcaattcgatgtgggtgaaaccgagttccttgacgtacggaatcagccgctcggcaagttccggccaggtgtactgacgcgccacctcaccgagatcatccagctcgcattgccacgaaccggcgtgcagctcatagatcgacagcggcgccgaatgcttgtgacggtcgcggcggctgctcatccagtcctgatcctgccagtcgatctgcaggggttccgcgacttttgacgcggtatccggcggcaggctggtggccagcgccatcgggtcggccttcagcggcagaatgccgtgggcaccgagaatctcgtatttatacagctcgcccgcttgcaggcgcggaatgaacaactcccagaccccggacggatgacgcaggcgcatgggatgccggcggccgtcccagacgttgaaatcccccaccactgacacgcgccgggcattcggcgcccacaccgcaaagcgcacgccgtcgacaccatccacggttcttagctgcgcgccaaggcaggcgctgaggtcacggtgattgccctcggcaaacagatacaaatccatttcaccgagcaactggccaaagctatacgggtcctcggcgacttgctcgccgccggcccagcgcgtgcgcagctggtaaggccgcgcctgatcgaaatgaccgacaaacagccccggcgtttcggtttgctccaacggaccgcgttcttcgccgctgtccttgtccactaccacgacgctcaatgcaccgggcagatacgcgcgaatgaattgcccaccagcgccatcgccgtgcgggccgagaatggaaaaagggtcgtgatgttcagcgcggaccaaggcgtcgatatctttcgccgagggcagcagcgcttctttgacctgaccctgttccttgtttgagaaactcatgactactctccaccaagatcggaaaagggtttaagccccgtcaataacccatacaaaccgtgcaacggcacgggcagccacgtggggcgattttcggcttcataggccacttcataggccgccttctccaggccgaacaacgcaagcgcagcgtcggcaccttcaggatcttgccaggcatgctcaagactagctgccgcgcggcgatatgcctgaacaaatgcctcacgggcctcacgcagatagcgctcggccaccagacgccgcgcagtttcagactcagcgctgtggtcaacgttgtgcacgttgatggtcatcgctgccgcgtaatcgaaggagcgcaacacgccgctgacatccttgtacgggctgtgtttgccacggcgctcgctcaatggccgcgccggttcgccctcgaagtcgatcagataggcatcgcccttgatcaccagcacctggcccagatgcaggtcgccgtggacgcggatacgcaagccacccgtggcttttttcgccagatcctgcacatgcgcaagaatggttttcttctcgtcgatcaggcgtttgaccagcttctgatccgctgcattgagctcgccctgatgttgcttgagcagcttcaaggcatgttcgacctgggccacgacatccttgcccgtggcctgcatgtccttggtggtcgacacttgcggggcgaagtcggcattgtcggttggcgcggcgagcaccttgtgcatctcacccaagcgctggccgagcatgccggcaaagtccctcagttcacccaacgcgttgtaatgctgctcctgttcggacatggcatcggccagttcatcgcgcagcgcccgttcgaggttgttctgcgtccattcccaggcgtcgccctgattgctcagatagccttgggcaatcatcagcaagttgtcttcgcccttgccatcgcggcggataaccgagccgagcagcggtgaaatattggcaaatccggcctcggtcaggtaagcgctcatctccagttccgggtgtacgccagaagcgactttacgtatcagcttgagcaccagactgttgccgatcaccaccgaactgttcgattgctcagcggacagataacgcacttccgcctcgccgccgaggccgagtttttccagttgcgcggtcggcgcaaaacggatttcgccctcggttgattccagcaccgtgttgttctgcatgccgtgcagcaccgcgcgaatgaacgcttcaaggctgaacgcatcggtgatcaaaccgacttgtcgcactcttcgtacacgcgacaacgccaattgctgcggcaacgccgggccgacctgatcttcggcaatgaagccaaacggcaattgataacgactggtctgcccagcgctggtgacttcgatttcgctgagcagcaccggatgctgcgcgtcgccgaaacgcacgccataggccagatgcaccttgtcgatgccagcatctttgccagcgaaccagcgccggttctgcagccagctcggcaggatgctctgctccagcgtcgtgcgcgacggcgcttcgagcaattcctccatgcgtttcttcaacaccagcgtggtgaagtccggcaggctctgcgccggttcgacgtgccagctcggcatctggttttccgcggccagtgcaaaccagtagaaaccgtaaggcgccagggtcaggaggaaattcaactgaccgatcggcgggaaggcattaccgccgagcatctccaccggcaccatgccgacgtaggccgacaggtccagctccaccgcttgcgcgctgcgcgagacgttggccacgcagaggataatttcgtgcttgccgtcggcatcggtgaattcacgggtgtaggccagcacgcgacggttgttcggtgagagcatcttcaaggtgccacggccgaaggctttcgactgtttgcgcacagcgagcaagcgtcgggtccagttgagcaatgaatgcggatcgcccgactgggtttcgacgttaaccgacagatagccgtactgcgggtccatgatcggcggcagtaccaggctcgccggatcggcgcgagagaaaccgccgttgcggtcgatcgaccattgcatcggcgtacgcacaccgtcgcggtcgccgaggtagatgttgtcacccatgccgatttcatcgccgtaatacaacgtcggcgtgccgggcatcgacagcagcagactgttgagcaattcgatgcggcggcgatcgcgctccatcaacggcgccaagcgacggcgaatgccgaggttgatccgcgcgcgacgatcagcggcgtagtaattccatagatagtcacgttctttgtcggtgaccatctccagcgtcaactcatcgtggttacgcaggaaaatcgcccattggcagttggcggggatttccggggtctggcgcaaaatgtcggtgatcgggaagcgatcttcctgggccaacgccatgtacatgcgcggcatcaacgggaagtgaaacgccatgtggcattcgtcgccgtttagaccttcggcatcggtgtcaccgaagtacagctgagtgtcttccggccactggttggcctcagcgagcagcatgcggtcgggatagttggcgtcgatttccgcacggatctgcttgaggacgtcatgggtctcggggagattttcgttattggtgccgtcgcgctcgatcaggtaagggatggcgtcgagacgcaggccatcgatgcccatgtccagccagtaacgcatcaccgagagcacggctttcatcacttgcgggttgtcgaaattcagatcgggttggtgcgaatagaaacggtgccagaagtactggcccgcgaccgggtcccaggtccagttggatttctccgtgtcgagaaaaatgatccgcgtgccgtcgtatttctgatcgtcatccgaccacacgtaaaagtcccgcgccgccgagccgggtttggccttgcgcgcacgctggaaccacgggtgctggtcggaggtgtggttgatgaccagttcagtgatcactcgcaaaccgcgcttgtgcgcctcggcgataaagcgcttggcatcggccatggtcccgtaatcgctgtgcacgccacggtattcggcgatgtcgtaaccgtcgtcgcggcgtggcgaggggtagaacggcaggagccagatggtgttgacgccgaggtcggcgatgtagtcgagtttggcgatcaggccgggaaagtcgccgatcccgtcattgttggagtcgaaaaacgatttgacgtggacttgatagatcaccgcgtccttataccagagcgggtctttgataaaggtggctgccttgggtttcttcgccatgtgaaactcctgttgaattctggataaaccgtgagccgatcatctggctcgaaaacgctgagcaacctgtaggagtgagcctgctcgcgatagcggtttcatattcagtagagttgtcgcctgcaagattgctatcgcgagcaggctcactcctacaatggttctgtgttcaggcagtgattcgccaaatgccgaacggctgatacgccgggtccaggcgcatgaactggtatttgccgtgccagtcccagcgatggccgttcatcaagtcttcgccgtgggtcgtcgcgtcatcgggcaggcccatttcccacaatggcagttcgaagttcgcctcctgcacgttatgcggatcgaggctgaccgcgaccagaatgaaattgctgccgtcaaaactgcgcttgccgaaatacagaatgttgtcgttccaggcgttgtagaccttcaagcccagatgcgtgtgcagcgccgggttctgccggcggatgcggttgagctgggcgatctcggcaatgatgttgcccggcgcggtgaagtcgcgaacgcggatctcgtatttctccgagtcgaggtattcctccttgcccggcaccggcgccgactcgcacagttcaaaaccggaatacatgccccacaagcccgaacccatggtcgccagcgccgcacgaatcataaaccccgggcgcccggattcgtgcaggaatgccgggttgatgtccggcgtattgacgaagaaattcggccggtagcattcgcgccaaggcgattcgttcagttcggtgaaatacgtcgccagctcagccttgctgttacgccaggtgaaataggtgtaactctgggtgtaaccaaccttaccgaggcgcgccatcatcgccggcgtagtgaaggcttcagcgaggaagatcacttcggggtaaagcgcgcgaacgtcagcaatcagccattgccagaacggcagcggtttggtgtgcggattgtcgacgcgaaagatcttcacgccctcctcgacccagccaatgacgatgtcgcgcagttcgacccacagactcggaatcgcgtccggcgcgtagaagtcgacgttgacgatgtcctggtatttctttggcgggttctccgcgtatttgatcgtgccgtccgggcgccagttgaaccagcctggatgctgcttgagccacgggtgatcctgggaacactggatggcgaaatcgagggcgatttccagaccatgatcggcagcagcggcaaccagtcggcggaagtcttcgcgggtgccgagttgcgagtgaatcgcctcgtgaccgccctcttcactgccgatggcataagggctgcctggatcatccgggccggcggtcaaggagttattgcgacccttgcggtgcgcgcggccgatcgggtggatcggcgtgaagtacaacacgtcgaagcccatgtcttgaatcatcggcagacgcgcgtgcacgtcattgaaagtgccatgacggcggggatcatcggtgatcgagcggggaaacagttcataccaactggcaaactcggccagttctcgctcaacgtccatggggaattcggcgctgacgctcaagtaggcgcggtgatcggcctcagccatcaattgcgcactgcgcgagtgcagaaacagcgcgacctgctcggtttcgagcaacccggacaattcgtggtgcaacgccgccagttgttcgctgagctggccctcgctgcgttcggcggcctgctgaaccatggtccggccttcctgcaactccagcgaaacggggacggcggcattgtgtttcttctccagttcgtactgaaaactggcgaagtgatcgatccacgcttcgatgcaatagaggtagcggccctgctgttcagggcggaactggccttgccagccattattgccctgatcggccatgacttcgctttgccattgctcttcgccttcctcgcgccagcggatgcgcaccgcgagtttgtcgtggccgtcggcgaacaccttgctggtaaccactacttcacgaccggcgatcgacttcaccgcgaactgcccgccatcgagggtcggcatggtgttttcgatggcaatgcgtggcaacagcaaagcctgcgacagtggcatatgcgggttgtagtttaattctgagggtttttcagcagtcattgagcatctctccttaacgccccaaggacgctcttgtgccggttcagcgttcgcaatcgagcgcctgcccggaatgaactcacttaggttccgagcgaccggcgccgggaaaagttcagatgaaattaccgtgtcagaaaagcggatcgaatttgccatgaggtggtcaatccacttaagcacttctcacgccatgtgccacacggaggtcatcagatgaatatcccgatcccggcggaaacgcccgatccgaacatcgacaaacccaccttgcccgagaccgagccgcagccgattcccgagcaggaaccaccgggcaccacgccaccgcctaaggaagaaccgccgagcacgatgccacccgtcatcgtctgactgatcgtgattgatcgttcccacgctccgcgtgggaatgcctcaatggacgctccgcgtccgctttgggacgcggagcgtcccgggctgcattcccacgcggagcgtgggaacgatcagaggtgggtcagttatttggtaactaaaccatccgcccggaacatcccgcgaatcccgcgcaccgcctgacgaatgcggtcctggttttcgatcagcgcaaagcgcacatgatcgtcgccatactcaccaaaccccacccccggcgagacgcacaccttggcttcggccagcagtttcttggcgaattccagcgaacccagatgcgcgtactgctcgggaatcttcgcccagacgtacatggacgctttcgggttctcgaccatccagcccagttcatgcaggcctttgaccagcacgttgcgacgctgacgatactgctcggcgatatcgcgcacgcattgctgatcgccttccagcgcggcaattgccgccacttgcagcggggtgaaggtgccgtagtcgtggtagctcttgattcgcgccagcgcgttgaccagttccggattaccgaccatgaaaccgatacgccagccggccatgttgtagcttttggacagggtgaaaaactccaccgcgatgtctttggcccccggcacttgcatgatcgacggcgctttccagccgtcatagacgatgtcggcgtaagccagatcgtgaatcaccagcacgtcgtactgcttggcgagggcgatcacccgctcgaagaaatccagttccacacactgtgcagtcgggttcgacgggaagccgaggatcatcattttcggtttcgggatcgaaccgcgaatggcccgttccagttcatcgaagaaatccactcccggcaccagcggtaccgaacgcacctgggcaccggcaatcaccgcaccgtagatgtgaatcggatagctcgggttcggcaccagtacggtgtcgccctggtccagggtggccagcatcaaatgcgctaggccttccttggaaccgatggtgacgatggcttcgctttccgggtcgatatcgacctcgtaacgctgcttgtaccagttggaaatcgcccggcgcaggcgcggaatgcccttggatgtggagtaaccgtgggtgtcgtcgcgttgggcgacttgtacaagtttttcgacaatgtgcggcggcgtggcgccgtcggggttgcccatgctcaagtcgatgatgtcttcaccacgacgacgcgcggccatcttcagctcggcggtgatgttgaaaacgtaaggggggagtcgatctatgcgcgcaaagcggcgcggcgaaccttgttcagccattgttgcctcggataacgtaagcgcccggaaccgtccgagcgacgctggtcactgcggtgacctgtggcggaagataaggtcagtgatggcatactgtccagcccgtttgtaaacaattttgtcccaaggaaatcggtagatggaattcaccagcggcttcttgctgagcctttcgctgtgcctggatatcggcgtggccaacatcgcgatgatcacattggcgatgcagcgcggttactttcagggcttcgcgctgggcctcggcacctgtgtcggcgacctgatttatgcggtgctggcgctggccgggatgacggttctgctgcaatacgaaactgtgcgttgggtgctgtggatcggcggctcggtgctgctgatctactttgcggcgaagatgatttactcggcgatccatcacgaagcgcaactggccgcgaccgccgaggtagggcagaactcccatcgcaaggagttcttccgtgggatttttctcgctatgtcatcgccaagcgcgattctctggtttgcagcggtcggcggcaccttgatcgcccgttccggtggcggcggccctttgagttcggcgctgttccttggcggtttcctttgcgcgggactgctgtggtcggcgggtttgtgctttgccgcgagccacggtggcaaactgctgggcgacaagctgttgcgctattcctacctggcatctgcagcgatcttctgctatttcgcggtgtacgtgatcgtatccggctataacgagtttgtcggttcgggcgccgtcgagcagttgcattcgctgtaagcgtgcgaattgggtttggctttctatactcccagccgaaccccttttttgttccaggagtcgagtcatggatgagcaaacacgcgtcgaagtggctgaacctcgcttcgaacatggacacttcctgctgattgcaggctttcgcggtcgatttacccaagacacagcaaaagacatcccggcgctgtgggaaaagttcttgccgcacctgggaaagatccaggggcaaaagaacgaagtgacctacggtgtctgcagcaacttcgatggcaagggcggcttcgattacatcgccggggtcgaaatcagcaagctcgatgacctcgaccagaaggtctaccaatgggtcgaagtgctgcctcggcagtacgcggtgtttgaacattcagggccgctcgaccagttgccgcagaccctgcaatacatctacaagacctggttgccgtcctcccactacgtggaactcaacgcccctgaactggagcgttacagcgcggacttcaatccgaagctgcacaccggcaaactggaaatctgcgtgccggtcgataccaaggcctgagcacacagccaaaaaggcggatcagtgatccgccttttgtttgcgcgatgagcgcatcgatatggctccctgattcctttatcctttcggcactttcttctgctgatttccgagccgccatgaacaccgtcattcgtaacgtcaccgctgccgatctggaccgctgctacgccatcgaaaccgttgcctacgaaggtgacgaagccgccactcgcgagaagatcgccacgcgaatcgccacttggccggaaggttttatcgtcgctgaggtggatggcgtggtcgccggtttcgtcaattccggtgcggcgtttgacgtgcagatgtcggacgaggcgttcaaagaattgatcggccatgacccgaaaggcccgaacgtggtgatcatgtcggtggtggtgcatccggattatcaggggcagggtttggccaagcgcttgatgggcgagttcatcgagcgtatgcgcgggatggataaagcgacgattcacctgatgtgcaaggaaaagcatattccgctgtatgccgggtttggctttgcctacatcaagccatcggagtcggatcacggcggcatggcgtggcacgagatgatcctgaccctctgactttatggatgattactgatcattcccacgctccgcgtgggaatgcctcctgtgacgctctgcgtcacgactttgggacgcagagcgtccccggctgcattcccacgcagagcgtgggaacgatcatttacgggagtatcagtagagggtgtcactgactcttttcggcgcttcacggtcgtaggtttcggcgtcgaactcgccatcattcagacgcttgtggaaggcgccggcagagggcagggccgagcgcggcaggtgcgtttgcggattccatgcgtcggagcggacgaacgctttcgagcaatgaaaaaacgccgcctccaccgtcaccagcaacacggttttcgccggtttgccattcaccgcaaaactctccagcagcgccggctctgcgctgatcagcgcggtgccattgacccgcaacgtctcgccaatccccggaatgatgaacagcagtgacacccgcgaatcctgcagcacgttgcgcagggtatcgatgcggttgttgcccgggcgatccggcagggccagggtgttttgatcaatgatccgcacaaaccccggcgcatccccgcgcggcgagttatccaggccatcggcacccaccgagctgacgatcaccagcggcgacaaccgcaccattgcctgataatcctcgttgagaaaaccgatctgcttgcgcaccgcgcggtcgtggggcagtccgtaaatcgcttccagcgcttcgattgaatcgatcatcgtgcatccctcgatgacttagaaaaccaggcccatgcgccgttcgtaaccgatccggcccttgtacgcttcaccgctgtcgacgtagccgtgcttggcgtacagcgcgatggccgcgtcgttatccgcatctaccgacaattccagccccttgatctccggccaggcctgacgcgcaacctcgggcagcgcttgcagacaagccttgccgtaacccttgccctgcgcgcggcgatcgacctgcaacgcatgcaaggtggcgctgtgttcatcggcccaggctggcaacaccggcgggcgtttgagcagcaaaaacgccaccggcacgtcatccgccaacagcgcaaagcccttcacgcccgggccgggtttcgacagtagggtgtgcaaagcgccgtggatatcgccagagaatttgatctgctcggcatggatttcaattgcctcgacttgctgacgctgcaaggcgttaaggctgtcgtacggcacgagttgggctgacacgggaatttcctttttcctacaaggtaagtcgccgattctagcgattttgtccttcgcggattttttttgtttcatctgtcgatctgcccatttgccgaacgactaagggtgtcttcacaacaaaaaccacggagaacaccatgagtgcacaatctgaaatccagaccctgatcaacacctaccgcgaagccgtcatgaccaaggacgtggagaaagtcatggcgttgtatgccgatgacatcgtctcgttcgatgcgatcaaggccctgcaattcaagggtaaagcggcttaccgcgagcactgggtggcgtgcatggaaatgtgccccggaccgcacgtcttcgaattcgaggaaatcgtcatcgaaagcgccgacaacatcgccttcgcccactgggttgccaactgcggcggcaccaacgacaagggcgaaacccagagctgctggatgcgcgtcaccgcctgctatcggcaagtcggcggggcgtggaaaatcgcccatgaacactggtcggcgccgttcgatccgatgagcggcgcgaccctgttcgatgtgactccctgatcttcagccatagttgaaccgtccgattcaggagaacgccatgaagtatttatgcctggtctacagcgatgagcacctgctgcattcatcgcccgacagcccggaagacgccgagtgctgggcctacgccgagtcgattcagggcagcgggcggatggtcgccgccgaggcgctggagtcggtgcagaccgccacgaccgtcaggatgcgcaacggcaaactgtcgatcaccgatggcccgtttgccgaaaccaaggagcaactggccggcttctacctgatcgacgccaaggatctcaacgaagcgattcaggtcgccggcaacattccggcggcgcgggtcggcagcgttgaagtgcgcccggtgcggcagttgaatgtctgaggtccggtcgcgggtcgagcaggtctatcgcgaagactcgcggcggattctggcgacgctgattcgtctgctcggtgatttcgacctcgccgaagaagccttgcacgaggcgttcttcgtcgcggtcgagcgctggcagcgcgacggcgtgccggacaatccgcgcacctggctggtctcgaccgggcgcttcaaggcgattgatgtgttgcgccgccgtgcgcggttcaaggcttcgcagcccatattggtcgcgcaactggaagaactcgaacaggccgattggagtggcgaagacgtggaagacgatcgtctgcggctgatcttcacctgctgccacccggcactggcggcggatgcgcaagtgccgctgaccttgcgtgaagtctgcgacctgaccaccgaggaaattgcccgcgcgtttctttcggcaccggcggcgattgctcaacgcatcgtgcgggcgaaagccaagatccgtgatgcgaaaatcccttatcaagtaccgagcctgagcgaattgcccgaacgcctcgacagtgtgttgcgggtgatttatctggtgttcaacgaggggtattcggcgtcgggcggggctgaattgacccgcgaagatctgacgcgcgaggcgatccggctggggcgcttgttgatggagttgctgccggagcctgaggtcatggggctgttggcgatgatgctgttgcacgaatcgcgacgctcggcgcgcacttcgccgggtggtgaactggtgctgctggatgatcaggatcgctcgcgttgggatgccgatctgatcgccgaaggttgtgcgctggtcgagcgcgcgctgaccacgcggcggtttgggccttattgcctgcaagcggcgattgccgcagtgcatgccgaggcgccaacggcgggggagacggattgggagcagatcgtcggcttgtatgacgtactgttgcgggcagtgccttcgccggtaatcgagttgaaccgggcggtggcggtggccaagcgcgacggcgcgctggcggggttgaatctgattgaagggattttggcgcggggggagttgcaggattatcacttggcgcattcggcgcgggcggagttttgtcggcagttgggcagggtggaagaggcgagggcggcgtatttgcgggcgttggagctgacccggcaggagccggaacggcggtttattgaagggcggctttcggcgctggaattgccctcaccctagccctctcccagtgggagaggggaccgattgggggatattggagagtttcaccgagttgaacgatcggctttgaatccataatcgaggtgtataccgtagctatacatccataatcgactcggtctttcaggtcgatgtctgacgcaagacacctcggtcggctccctctccccaccgggagagggctggggtgaggggattttgagatcatatccaatgaatccataatcgactcggtctctcaggtcgatgtctgacccaagacacctcggtcggctccctctcccaccgggcggtccgacgtttcgggagggctggggtgagggtggctctatcttcaccgctattccagcatcttgctgagcaaccaactccccgccggccccggcggatacagccgcgaccacaacgcatcgacaaacaccggtttcggccagccgcgcaccttcaactccaccagcaaatcattgccaaagcgctgcgccagccaacgcggcaacggcgcccagccaaaacctttctcggccatttccagcagcatcaggtaactcggcgccgaccacacccgacctttgccgcgactgtcataaggattgacgatggtcgccagacgcaattcgcgatgctgttccaggatgtgctgatcaatgtgatcgagcttggccagcgcatggtcgcgattaacgaacaaggcaatttccgtacgctcggccaccgtcgaggtgaccagatccggcgggtagttctcttgcatttcagcgaacgccagatgcgcgcgaccacgctgcaccaactcgaccaggtcatcgcattcggcgatcagacactccagctccagatccggataacgctgctcaaacccgaccagcgccgcttcaaaacggtacgactgataagtatcggaaatcgccaccgtcagcttcggctcgacgccttgggacaactgccgcgcagtcatttccaagcgactgctggccgccagaatcgcctcggcgcgttgcagcatcacatgcccggccggagtcagcgtcggtttgcggctgctgcgatcgaacaactgcaaatccagatcaatctccaggctggccaccgccgcgctgatggtcgactggctgcgcccgagcttgcgcgccgctgccgaaaacgaaccttgcgtggcagcttggacaaatgccagcagcacttcctgcgaaatcatcaactatcgccttgatcgatggttattggttatgaagtatcgatgcgagcatagatcatggcaaccatcttcactcaaggactcaggtcatgactgcccacaaatccattactgaacgtattttccaggccatcggtttcgaactgctggcgattctgatctgcaccccgttgctggcgtggatcatgcaaaaaccgatgcttgaaatgggcgcggtgacagtattgatcgccatgctggcgctgggttggaacgtggtgttcaaccgcttcttcgaccgcatgcttgcgcgaatgaatgttgcacacaacgcctgggtacgggtggtacacgcgttgctgttcgagggtggtttgatcgtgatgggcgtgccgctgattgcctggtggctgtcggtcagcctgtggcaggcgtttttgctcgacattggcgtgttgctgtttttcctgccgtacacctatgtgtatcactggggatatgacgtggtgcgcgagcgcttcatgactcgcaacgcctgtcagaactaacaccgatccccgtgtaggagctgccgcaggctgcgatcttttgattttgtttttaaagacaagatcaaaagatcgcagcctgcggcagctcctacaggcgttaaatgttttcagtgaagttagaggaacatgcccccggaggcctcaacccgctggccattgatccactgcgcacccggcgacagcaacagcgccaacgccccgccaatgtcatccggctgaccggcacgacccagcgcagtattgtcggcgaccatcgcattcactgccgcattgtcgcgaacggtgccgccgccaaagtcggtttcaatcgcacctggcgccaaggtattcacggcaatctgccgtgcgcccagctctttcgcctgatagcgggtcaggacttcaatcgcgcctttcattgcggcataagcgctggcgccggcaatggtgaaacgcgctagaccactggaaatgttgatgattcgcccgccgtcgttgatcagtggcaagagttgctgggtcaggaagaacggccctttgaggtgcacattcatcagcaggtcgaattgctcgacggtggtctcggcgaaaccggcatgcaagccgaccccggcgttgttgatcaggaaatcaaagcgctggcggtcgaaggtctgctgtaacgcttgctcaacacgtgtagcgaaatcggcaaagctctcgctacggccaacgtccagctgcagcatcacggctttgccgccgagagcctgcacttcggcgaccagcgcctgggcttcatcggcgcggctgttgtaggtgccaatgatgtcgatgccctgcgcggcgaggtgcagtgcagcgtttttgcccaggccacgactggcgccagtgatcaatgcgattttgcgattcatggtttttcctcgattgccgtgagtgatcaggtgatggatcaaagtttatttatccgccctgtggtgataaacaggctgaatccggaatcactgatcggttaggccgaacaatcaataggtggcccatgaacaaactggaactgctgcgcaccttcgtccgggtcagcgaactgtcgagtttcactctcgccggcgaaagcctcggactgccccgctcaacggtgtccgaacacgtgcaagcgctggaagccctgctcggcacgcgcctgttgcaacgcaccacgcgcaaggtgcaggcgacacaggacggtctggtgctgtacgaacgcagcaaggatctgctctcgcacatggacgagatcgaaggcttgtttcgacaggacgaagcgtcgttgaccgggcgcattcgtgtcgacctgccgaacattctcgcgcggcgcctggtcatgccgcgcctcccgcagttcatggatcggcacccgcatctggaactggaaatcagcagcacggatcgccgcgtcgacttgctcagcgaagggttcgattgcgtggtgaggattggcgcgcagccggatcaatcggtggtcgcgcggcacctcggtgacttccccatggtcaattgcgccagccccgcttacctcgaacgctacggtgtgccgcagtcgctggaagatctcgcgcagcatcgactggtgcattacgtcggcgtgctcggttcgcgttcggaagggtttgtgtacgaggagggcggccaggtgaaacgcttgccgatggctggcagcattacggtcaacagcactgacgcttacgagtcggcgtgcctcggcggcttcggtctgactcaggtgccgcgcaccggcatgcaaccgcatctggaaaacggcgaattggtgacggtgttgccgcaattcaccgcgccggcgatgggcatttcattgctgtatgcgcggcaacggcatttgccgttgcgggtgcgggtgttcatggactggctgggcgatctgattcgctccgcgctctaaacctgaacaccggtcaaaactgtaggagtgagcctgctcgcgatagcggtgtgtcagtttaatcaatgttgactgatacaccgctatcgcgagcaggctcactcctacaggggactttcttcggtcagaagatctgggtgaacagccagtacaggctgcccgacagcaggatcgccgccggcagcgtcagcacccacgccatcaacagattacggatggtcttcatctgcaacccaccaccattggcaaccatggtcccggccacacccgaggacaacacgtgcgtggtcgacaccggcaaaccaaacatgtccgccgcgccgatggtcagcatcgccacggtttccgccgacgcaccctgcgcatacgtcaggtgagtcttgccgatcttctcgccgaccgtcaccacaatccgcttccagccgaccatggtgcccagccccagcgcgatggccacggcgatcttcacccacagcggaataaaccgcgtagcgttgtcgatctgttgcttgaacagttgcagtttgctgctggtatcagcgtcgaaattgccgaccttgttcttatccatcaggcgaatgctttcgctggccaggtacatgtcgttacgcacgttgcccatggcttcggccgggactttcgccagcgagccgtagcctctgacttcttcgccaatgtgcccggtgagagcggcaagggcggggataagttgcggagtaggctctttgctgcgcacgtaatcggaaaggactgcacgcggatcggccggcgtcggcagcggcgcacttttcaccagtgcttgctgggtgacctgcgccacagcggcgaactgcagcgattgctcttcgggcatggtgcggttcaaggcataagccatcggcagcgtgccgaccagaatcaacatgatcaggcccatgcctttctggccgtcgttggagccgtgggcgaaggacacaccggtgcacgtggcgatcagcaaaccacgaatccaccacggcggcggagtgttgccttccggtgctttatagagcgagcgattcttcacgaacgcacgcagcgccaacagcaacagcgccgcacaaccgaaccccacaaggggcgacagcagcaaggcgtaaccaatcttggtcgcctgcgcccagtcgacaccgctggtgccgtcgcggccgtgcatcaaggcattggccacaccgacgccgatgatcgaaccgatcaacgtgtgcgacgacgaggccggcaaccccagccaccaagtgccgaggttccacaggatcgccgcgatcagcagggcgaaaatcatcgcgaaaccggcagacgatcccacctgcaaaatcagctctaccggcagcaaggcgatgatgccgaacgccaccgcgccactcgataacaacacgccgagaaagttgaagaagcccgaccagaccaccgcgacattcggtggcagcgagtgggtgtaaatcaccgtcgcaacggcgttggcggtgtcgtggaagccgttgacgaactcgaaacccagcgcaatcagcagcgctacgccgagcagcaggaatggcgtccaggtggtcaccaccgtgccgagttcgtgcatgtcgtgcatcaggctataggcggtaaacagcatccccagcgccagcacggcgaaaaagattacgtaggtgaacgggccggttttcttatcgagggctggtctgccgctggcggcggacgcggggctggcggtcagggaaggagtagccatgagcggacaatcctgagcgagggaaggaatgtcgcccatgatcgttgcagaatgttacagagagactgcgccatgtcagtgtttgcgggattagcctgaccattgatctgaagggcaatgatcaacccctgtaggagtgagcctgctcgcgatgacgttggcacatttaaagcagctgcgtctgacacaccgctatcgcgagcaggctcactcctacagggggaactgtggtggggcacagtattttggggctcaataatccccgcgcttgcgaaacgcccaacgcccggcgatcacggtaaacgtcgccaccagcgcgaccaatatccagaacccttccggatcctgcgacaacggcaccccgccgacattcatcccgaaaaaaccggcaatgatgttgatcggcaacgccagcaccgtcaccaccgtcagggtaaacagcgtgcggttgctctgttcgttgaggttggcggcgatctcttcctgcaacagtttgatccgctcgccgagcgcggtgagatcgttgatgatcagcgcaaactcctcggtggatttgcgcagctccttgacgtcttccttctgcaaccacggcggcgggcgattgagcaggcgcagcaacgaacccggttccagcgccaacagccgttgcagacgcaccagcacccgccggtttgcaccgagttcagcgcggttggtcgacagtcgcgaggagagcaattcgtcctcgacctggtcaacgctcatgctcgttttacggacgatctgcgtgagcacttcgccctgatcgcgcagcaggtgcacgagcagttccgagggcgaacgaaagcgttcgccggccttcactgacgagcgcaatttgtccaccgaatgcagcggttgcagacgcgcactgacgatcagtttgctgcgcacgcagacccacagcgtcgatacgtccgaggagaccatgctgctgaggttgaacaccacatcgttgaccaccgccagcaacgccgaatcgacatgctcgatgcgcgtcgaacgcgagccttcgtgcagcgcctcgaaaaactcttcgggcaattgcagatgacttttcatccagcgctcgcacgccgcgtgcgccagattgagatgcagccagagaaactccccgttctcgttatcgtcttgcaggcaacgcagggcagtcgccgaatcgacttcgcggccacgctcgccaggcaaaaaacgaaaaccgtagagcaagccaaacaggtcaggatcgcgatggctgatgtcgaggctgtggttcatggcggctcgctgcgaggagggtgcgtcggtcgcgcaaatggcaggttcactgagccgcatcatcgcactgtcacatgacgtttgtgtgacagcaagatgacgtcaaatcagcaacttaccggcagtcggattttcttcaagaagcgctctggcgcgccgatcacaggtgcgttaggttgcgcgccattggccatgaaccaaggctcgccgacatggatgtccggcaaaatttcacgcctcaccgggcgtgcctcatccttgtcctgagtatctttcgatgctgcaaaaatccctgagagcgcaaattctcgccctgctgagcggcagtctgctggcgatgctgttgatcgccctggcctgttttcatttcctctccaacggcgtgcaaagctacagccagttgatcgccggtccgttgcacacctcgcaactgatcgacgaagccaacctgcaattcaaggtgcaggtgcaggaatggaaaaacgttctgctgcgcggcaagcaaccggcggatctgagcaaatactgggggcagttcgaagaccgccagcgtgatgtgcaaaccattctcggtgaactggccagccagaaaggcatagaaccgaacctgaaatcacgcatcgaacgcctgcgcgaagagcaccgtcaattgggtagcgcttatcagaagggccgcgatgcctacgtggctgccggtggtgatccggcggcgggtgatgcagcggtcaaaggtgttgaccgtgccgccagtgatcagatgagcgaactggtcgccgaattgcgcaagcaaggcaccgcgcagtcggcgctgatcagtgccgaggctgatcgcaccgtgtggctggggctgctggtgatgctcgcgtcggccctgttgattggcctgttgagcctgtggctggtcaaccgcaatctggtcgagccgatccgcaagctgatcgattacgtcactcagttgagtcgcggcaaactggctgaacgcgtggtcagcgaccgtcaggatgagttgggcaacctcgctgccgccgccaataccttgcgtgattttctcgccgaaaccttcacccgtctgcagcgcagcgcggcggatctggacagcgccagcggcgagcttaacgccatcgcgacgaccatggccggtggtaccaacgagcagttcaaccgaaccgatcaagtggccacggcgatgaacgaaatgtccgccactgcccaggaagtggcgcgtcatgccgccgatgccgcacgggcggccgacgatgccgaccagtccgcccaacaaggtgagaaggtcatgcagagcaccatccactcgatcacgcagatgcgcggcgaaatcgccaacaccgccacggtgattcgtcgtctggaagccgacagcggtcgtatcggcaaagtgctggaagtgattcgcggcattgccgaacagaccaacctgctggcgctcaacgctgcgatcgaagcggcgcgcgccggcgaggccgggcgtggttttgcggtggtcgccgatgaagtgcgcaacctcgcgcagcgcaccgccgagtcgatcatcgagatcaaccagatcattcagagcgtgcagaccggcgcggtggacgcggcgcaagccatcgacagcggccagacgcgcagcgatgaaagcgttgagcaagtgactcaggccggcgcgatgctggagcgcatcacccacgccgtggaagcgattcgcgacatgaaccggcagatcgccacggccgccgaagagcagacctcggtggccgaagacatctcgcgcaacctcaccgagatcacctcgatcgccagtaccaacctcgacaacgtccagcgcaccgaaagcgccagccagaacctgcatggtctgtccgggcaactgaacgaagtcactgcacgcctgagcgcctgaggccattgactgtgtaccgattcggataccgagtcggtacacagtcgatctcaattacctgcggccgtggtcgatgaccggttatctatcaccggcattggagtctttccatggtcagcattacttctgtttcgatcaatcagaccgtcaccacaccttcgagcaaaaccgcgatcagcgacgtcggtgacgatacctcgaccacggcagctgccagcactggcgtgaaagcggacaccagcaaagtggctgcgggcggtggtgcagcgccgacgggtgacagcgattccagcagtgaagaatcggattcggtgaaagaactgcgcaagcagatcgccgagctgcagaagcagttgcaggaggagcagcaagcgttgcaagcggcgcaggcgaagcaggaaaattctgatgcgaaggtcgccgaagtagccgccgcacaagcgcaggtcaccgctacctcggcgtccctgtcaaccgctaccgcctcgctgttgcaggcgttgcaggactccgacagcagcacctccggctcgttggtcagcacttcggcgtgatgccctttcccctcaccctagccctctcccagagggagaggggactgaccgaggtggatgttggaggtacatcgacttgagagacctgtgtcgaactcaggttttgaaaggtttgaaggtctgctcccttccccctcgcccccttgggggagagggctggggtgagggggagaaaatctcactgacaacacatcaaccaagccaaacaccagacacaaaaaagccgcacgatctttcaatcgtgcggcttttggtagtgcgttcaatcaagtgtcttgcttgttgctcaacaccttgccagtggtcgcatcaaagtccacatcgaactctttgccgtcagccgtcttcagctcaacttcgtactcataaccgttgaagtggttatccagatccgtgtcagtgatggtcgcacccggatgcagtttcagcgcttcggcgttcatcgactccagcgacttgatcttgcccgacttaaccagttcaggaatctggtcaacgcgaacatcagcctgggccaggccagcggtaagagtcagggcagcggcggtaaacagggcagtcaaagttttcatcggttcattccttggttgattcgtttaagtggcctcaggttaaccagcgcaacttaactcacccttaaaaccctgcacccaaacaaaacgggcaagccatgcaccggcacagaacctgtgggagcgtagcttgcccgcgatgaaggcgcctcgatttcagatcagaaaccgttgttcttcaacacctgatcaacactggccgatgccgggcgtttatagaacttcaacagctcgctggcgcggttggtgaagatgccgtcaacgcctgcggccatgactttctcgaagtccactggctcgtcgacggtgtagacgtggaccagcatgccctgatcatgggtgtatttgttcatccacggttgcaccagatccgaatagctctgatcgccgtcatgggtcagcttcgccgaagggccggtgccgattgcaccctgggccttggcgtaatccacccattgcttgaactcagcttcggacttcggctcctgcttgccgtagaaaacgtttttgtccttctcgccggactcggcaaacgtcaccttggatttcggctcgatgctgccggcgcccacccacagcaacaggatcttcggcacttgcggcatttccttttgcagcagttcgaggctgtttttctcgaaggtctgcaggatcaccttgcctttgccctgacccacgcccagcgcgctcttcgccagtttcgaaccggccggactcagccagccgcgatcctgcagtttttctttcaggtcatgttcgatgcccgggaacagttgcggctctttggtctcgatgtacaggcccggcttgtgttgtggattggcctgggcgatgtcgatgatttcatcgagggtgagaattttcagcccagcgtaggacgggcgggcgcggtccgggtatttggtgttgaaccaactgccggcgtcgagggttttcagttcggccatggtgaaggccgtggccgggctgtccttgcgctcagggaacttggtggcgacgtcggtggtgcgttgcaggttgtcgtcatgcaaggcgaagagcacgccgtccttgctgcgctgcaaatccatttccagataatcggcgcccagatcccgggccagtcggtaggacgcagcggtagattccggtgcatcgaaggaagcgccacggtgggcgatcaccgctgggtgcggaataccgtgcgttgcagcgactgcgtcggggtccgtctgagtcgcggcgtgcgcctgaccgaggccaagcagcaggctcaggaccagagcgcttttggtgaaagtggcgggcatgttcgagttcctttcgcagggcattttcaaagacgtaccttttaacaactgaatcgattgcgtgctatcgcaggaccgacataaacgtattaaaagcgatttttcctgcacttttgtggcgcggtttgcagtacgcttgcccacggcagacgctccggcagagggcgcgccgctccgttgccctgcgtgtaaaccattgatcatttttcgtgaggtttaccatgcgcatcacctcccaactcatctgccaggcagccgacgacctcaagggttttgtcggcctcaatcgcaagaccggtcggtacatcgtgcgtttcagcgaagattcgtttggcatggacgtggccgatgacggcattattcctgtgaatgaattcgtctgggcgccggcgacggcgcagaccatgacgctcaaacgcgacttgattcagttgttgctggatcagcatatcgatgaccggatcaacatcaccgagccgttgcgcgtttatatgagcaaggttgaagtgccggagattgtcgcgttgcgcagtctggtgcgtggctgaagttatgctgtgagggtgagggcctcttcgcgagcaggctcgctcccacatgggaaccgtggtgttcacaaatcccctgtgggagcgagcctgctcgcgaaagcggccgtcaatgcaccgccattttattgcccgaaccgatactcacgctcaacccgacacactcgcgtatgaaacgccgaataccattgcgaacgcccacgcgcttgaatcagctgatgctcaggattccgccgccacgccagaatcgccgcttcgctgtcccaatacgacaccgtaatcccgacgccatcggcccctcgaaccgactctaccccaagaaaccccggctgctcactgaccaacgcagccatgcgctcggccgcctcggcatagccgttgtcaccttcggttcgggtcgacgtaaaaatgaccgcaaagcaatcagccatcaacgcggctccatgcaagcttcgacaaacgcccgcaccagcggcggcatctgccctttgagcgcggcgcgttcaggctgaaacagtgtggcgacaaagaaccggtgatccttgagttcaatcgcgcgtaaatcccctgacgaatcatgaccgacagcatgtagccgatcgttcaacagttgctgttcgaacagcggattcacaccgaagcggcagcgataaccttcacgaatttgcgacgtttcgtacgccttggcgatcaacgaaccgggcaccaggtaaatgctgtccaccacttcgaccagcgaacacgtcaacggcgtgagtaccgcgcgttcagagtcgggcgatgtttcaccgtgtaccgcatccacccagcccagcacgttgcgggaaaattccagcaccgcatgctgaaaaccgccgcaggtgccgaggaaagggcgctgctgttcgcgggcaaaacggatcgcccacagtgcgccgtcttcactcttgtaagggctggcgggtacgcaccagaaaccgtcgaactcgcggagtggcgtatcgccgtggatctgctcggtaggcaaccattcgaattgcacggtccggttgaggtgttcagcgaccagaccgagggcgacgggaatggcttggtgtacggtgacctgcgggtcgtaatcgccgatcagggcgatacggatggcgctgttttccatgggggttccctgcgcttgttgattgatggcactcactatagattggcgttcacgcactcaatatgggcgtttccccaagtgatcaatgcagccgcgcactatcaactcgactaccccgacctggccctgattcttgccttggtgcgtggcggctctctggctcgggcttcgcagttgttgaaagtcgatgtgtcgacggtgtttcgtgccgtgcgccgtctcgaagctgcactcggccagcaactgttcgaaaaaagccgcgccgggtatctgccgacaaccctcgcgcagacgctggccgagcaagccgaacgcgctgaacaggcattggaggcggcgcggatcggcgtggagcagggcggtgaagtggtcagcggcacggtgcgtctgacctgtaccgattcggtgctgcagagtttgctgctgccggcgctggcgcagttcatgccccaatacccagcgctgactatcgaactgagcacctccaacgatttcgccaacctcagtcgccgcgatgctgacatcgccctgcgcctgacgcggacaccgcccgaacacttggtcggacggcaactggcgaagatttcctaccgggtctgtgccagttcgcgttatctgcagaacgtcgatgcggcggatctggccgcgctgacctggatcgccccggacgactttctccccgatcacccaaccatcgcctggcgtcggcaacacctgcccggtgtgactccgggctatcgctgcaacagcatgctgtcggtcaccgaactggttcgcgcaggcctcggcgtggcggcgttaccggactttctgatcaccgacggtttgcaggcattaagcgaaccgctgcacggttacgacaccgcgctgtggctgctgacgcgcccggattgccgggcgttgcgctcggtggtgacactgttcgatgagttggggcgggcgctgcgtttatcgtgatcagcgctgcgggttctggcgcatgtgatcgtgcaactcgctggtcaggctggcgattcgttcagtgaggtttttggtcatctcggtgaggcgggtgttctgctccagcagttcaagcagttgcgcggtgttcttcgccgcttgggcctgacgctcggtattggcctgtgccaacgcttcacggtgttgcgcgtcggcatcggcttgcgccttgtcgcgggcggcctgacgggtttgtgcgagcaaaatcagcggcgcggcgtaggccgattgcaggctgaaggcgaggttcaacaggatgaacgggtagacgtcgaaggtggttacgccaaacacgttcagactgacccacaacaacacgatcaacgtctgcgcgccgagaaacattggcgtgccgaagaaccgcgcaaacgcctcggcgcgcagggcgaaggtgtcgttgccgaaggtggtgttgaggtgggcgtgggggcggtggaagcgcaggtgatcgacgggagcggattccggtgttgcgggtttttcagtggtcatggtgcactcggcagggcgtgggacgtgtagtcactatagccctgcgttgtggcgaccggccctttcgcgagcaggctcgctcccacaggtattcggggcgttcacaaacattgtgatcaacctaacccctgtgggagcgagcctgctcgcgaaggcgacgacgcggtctaactgctttgcacaaggcttaacccggcgcccgctcattggcaaacatgctcaccgcatccaccgcctcactggcgccatcacgaatctgcaagatcaccgtgcccgcttgattcgccaattcgacgccttcagccgcgcgaccccgggtgccctccatgctcttgatggcctggcgggtctcgttctggatcaggctgatcatgctggaaatttccgccgtcgagccgctggtacgccccgcgagcaatcgcacctcgtcggcgaccacggcaaatccgcgaccttgttcaccggcgcgcgcggcttcaatcgcagcgttaagcgccagcagattggtctggtcggcaatcgcgcggatggtgttgacgatggcggtgatctgctcggagcgctcacccagttgcgcaatcaacgtcgacgattcggcaatgtcctcggcgatttcgcgcatttcgctggcggcttgctggatcacctgcgtaccttgctcggcgacttttcgcgtggccaccgagatgtgataagcggcgctggcactgcgtgcgtcctgctcgtgttgctcgacgcgggcggtcacgtcggaggcgaacttcaccactttgcacaagcgtccggcagcgtcgtataccgggttgtagttggcttcgagccacaccgtttgcccgcgtttatccacgcgttcgaactgaccctggaaaagctctccctggttcaagcgccgccagaaatcctcataagcactgctgttgaccagtgccggggtgcagaacaaacggtgatgtttgcctttcagctcggcgagggtgtaacccatgcgcgtcagaaaattctgattggccgtgagaatactgccgtcgaggttgaattcgatgaccgccattgcccggtcaatcgcctgcaacttggcgttggcctcactttcctgctgcaccttggcggtcacgtccatggcgtacttgaccactttcaccacacggcccgaggcatccttgatcgggttgtaactggcttccagccagatcggctgacccttgccgtcgacccgttcaaacgtaccggactgaaactggccgtttttcaggcgagaccacaaatcggtgtactgagcactacggccgaactctggtgtgcaaaagcgccgatgcggttggccgatcgcttgttcggcggtgtaacccagggtcttgagaaagttgtcattggcgcgcagcaccacgccatcaaggtcgaactcgatcaccgccatcgagcgattgatcgcgtcgagcaggccggcttgttcggtgagggtgcgctgaaggtcgtcgacgacggctttgtggcgattgaagaacatgctcgcagtactctggaagaaggggaagatcgaggattcagtccctatttccgcgctggcagaccgaatgcgcggacggcattcggcggtgactgctcaatgccagcattccttaactggcagatggctacttatacaaaacttcataaagttgtacaacaaagtaattatttgtaattttgtataactttttaggcgccggcgttgtccgtctcggtacggctcaaggctacgttgatagtgttgcggcccttatgtttggcggtgtacagcgctttgtcggcatcgtccagccagtcgagggcatccttgtacaagggctgataccgcgccagaccgatactcagacccactcgcaagtctggcacctgcggatgacgatactgctgcaatgcctggcgcaattgctccatcagcgcttcagccttgttcagcggcagtgccggcaggatcacacagaactcgtcaccgccgtagcgcccggccaactggtgctgatcgagcaggcgtttgaggtcgtgactcaattgccgcagcaccgcatcgccgacgatgtgcccgaagctgtcgttgattgccttgaagtgatcaatgtcgatcaacgccagcgtggcttggctgttgtgttggcggcactgctgaaatttcaggtgcagcaggtctttccaggcaccgtggttgagcaggccggtgaggctgtcggtacggctgagggcgctcagtgcgcgtttgtgttgggagagtttgatcgccaggcgataacagaccatgcccagcgccagcggatacagggtgagcatcggcaggcaggcccagacttgctcctgtgtcatcgtcaggctgaattggacaccaaagatcatccagcccagcaatacgccggcgagttgggcgagggcgccgaacacgaacaaccgatagccaccggcggcgacattgttcatggtcatcatcgacaggatggtcacggtggtcagcggactgaactgaaaacatgccgcccagaatccaccgcacagcgagtcatacaccaggttgcggcgttcagcctgatacgggaacgccgagcgagtagaaatctgataagccagatgtggccaggcgaacccgttgaacaacaacagcgcccaaacccagccgggcatgttcagcggatacaacgcagccccgacgctgaaaaaaccgatccccagaccgatggcccggggaaggtaaatgcgccgggcgaatgacaagcctttgccgcgttggttttccatgatgccctgcgcgaaattcatcctgaaatactttgcagtattttttcaggcagaccgtccgtcggtcgattgtcggacattgtcatttattccaacgcgaataatcagtgtccttccgagccatttaatcgaggacgtgtgcaggagaaaggcgagttagagctgataacgcgccaaaaacatctccagcgccgattcggcgacggtgtgctgcatatcggcatcgagcgcggcgcggcccatcgacatttgcggccagaagccaaaagtcttcagcagcccttgcaactggtgcgcggcaaactccggatcgaccggtttcaagcggccatcggcctgtgcggcacgaatccatacggtcagaccttcctcgcgctcgcccatgcgctcgaccatgttctgcgcgcgctccggcgaatggatggtggcggcaatcgccactcgtgccagggttagaaagttctcgtcggccatcagttgcactttggcctggagcatttgccgtaactgctcgctcagtggctgatcgcggttatagaggaccgtttgctcggcgctgatccgtgtccataactggttgagaatttcggcgaacagctcttctttgctggggaaatggttatacaccgtgcgcttggatacaccggcggtagcggcaattttgtccatgctggtgatctcgaatccgtgggcacggaattcggcaatcgccgcctggataatggcttcgcgtttacggtcggtgaggcgctgtggagctgtcataagtacgcttcggcagagaaaagatgaaattacacttggcagtttacttgtcatccgctttgatgcaacctagaaactacaccggtcagtgtaatgttgcgttaatcctcgcaatctaaaaaccagacagttcggcctatgcgtgcagctttggccatttatcgtcccatcgtggaaaaaccgtgaattgcgcggtttttctggagtcattcagtcatggccaatccagtttcgatcccggataacacatccacgcctgaagcctcgcggcagaaccaggggctgtttcgcaaccacgcacctgtgcaacgcgaaggcctgcgcaagatgctgcggatcatgtggaacatgattttccacaaaccgcgcaacacccggcccgcagcgccgatcccggtgcaggcattgacccgcgaagagctgctggcagcgcccaaccacagcgtctatcgcctcggtcactcgaccttgttgctgaaactgcgcgacaaattcttcatcaccgacccggtcttcgctgagcgtgcttcgccagtgcaatgggccgggccgaaacgtttccaccagccaccgatcagcatcgatcagttgccgccgatcgaagcggtgattctgtcgcacaaccactacgaccacctcgattacgcggcggtgctcaaactcgcggccaagaccacttacttcctgaccccgctgggcgttggcgacaccctggtcaaatggggcatcgatgccagcaaggtccgccagtacgattggtggcagggcgccgagattgccggcatccgtttcgtcgccacaccgtctcagcacttttccggccgtggactgttcgacggcaacagctccctgtgggcgtcctgggtgatgatcgacggcgacacccgaatcttcttcagcggtgacagcggctacttcgacggcttcaaacgcatcggcgaacagtacggcccgttcgacctgaccctgatggaaaccggcgcctacaacgtcgaatggccgcacgtacacatgcagcccgaagaaaccctgcaagcgcacatcgacctcaaaggccgctggctcttcccgatccacaacggcaccttcgacctggcgatgcacgcctggcacgaaccatttgaccggattctggcactggcgtgggaacgcagtatttctattaccacgccgcaaatgggtgaggcgtttaacatcgctcaaccgcagcgcggggaggcgtggtggttggcggttgaaggggagagtgagggtgtggtgcagaacgcctgatcagatgaagacggttcgcgcctaagggggcgaaccggttgctccagaaacaagccctgaaatcttacggctgtaatcagccatagtagtaaccgacacttctcgaaattttccacgaagtaattgctgcaggttctccagaggtattcccagtctgtgtgcggcttcagattcgcttatgtcggtggactcgatgagcgagatcaatttggtcgcgtactcggacttgagcagcatcttgcctgcatgctcaagctctaaatcttgataaacattgcctgtgctttcttcgatctcgctcatgtttttatccttactcagccatcgcaaaatccccacgccccatagcatccgccgacacgccctgaacactcgcactacgccccggcgcaaacccgggaaaaaacaccagcccctgcgcctcaaaccggtaagccagcgccagtcgcaccgcatccgcgacatcctgctgcgcttcaaagcgttgaatgtcttcaaccgaaacctcagcctcccgcgagagctgttccacgctccagcccagcatcgctcgggcctggacgcagtgcgtcggggtgaactggaaaagggcaatgcgttcgaggatgtggttcatcgcaagagaggccatggtgtgctccgggctcaagagtgctgattgaaaatgtactgtgtttttgtacagttgttttcggccgggatcaaacgcaattttcgatttgccctagttcgacgcctgcaaccagacggacggtgcctgcccgaggatccgccggaacatcgtcgagaacgccgccgggctttcataaccgaagtccagcgcgatgcgtgtcacggcttgacccgaggccaagcgtggcagcgccagaaccacgcaagcctgctgacgccattggctgaaactcaacccggtttgttggcgaaacagtctgttgaaggtgcgcaagcttatgtgtaattggtcagcccactgctttggcgcttggtgggcgtacggctgatgcagaaagttctgacacagagacaggagctttccgtcggttggtagcgggatgtgcaacggcagcggcgcactgcgcgtcagttcatgcagcaacagatcgatcaacacgccgtcgcgtccgcccaagtcataggtcagcggtaactccaccgactccatcagcaaatgccgcatcagcggcgacacactgatcacctggcagcgctcccccaaatccactgcaccgggttcgatgtacaagctgcgcgtgctgaccccaagcatcaacacctcgtgcgccacccccggcggaatccataccgcgcgctgcggcggcaccacccaattgccgtcatgggtgctgacctgcatcaccccggtcgcgccgtacaacaactgcgcccgccgatgcgtgtgaaaaggcagcaagtgaccgtgggaataatccgtaccgatcgccaccaccgcgcgcggcgtgtcatccagcagattgatcgaaacattgcgcatcaggcgtttcccagtggttggcgtaaacgcaaacattattggctgacttgctgaagcaggccaagcgctgccgctctatcgtcgaccgttctccctacacggacgcctcgatatgttctatttactgctgaccctcttcggttgcctgaccggcattaccgccgtgctgttcggcttcggcggcggttttgtcgtcgtgccgctgctgtatcgcctgctcaccgccagccacggcgccgatgacccgatcggccaatcggcgatgcacatcgccgtcgccacttcgacctgcgtgatgatcgtcaacgccctgatcgccaccgacaaacaccgccgcgccggcaacctgatccgtcattacctgtggccgttgggtgggtttatcggcctgggtgcaatcgcgggtgcaatggcggcggtgtgggtcagcggcgacgtgattcgctacgcattcatcggctacctcggcgtgaccatcgtcgactgcctgctgcgacgcggctttctcacgcaaaactcagacgtcatcccacgccgacttggtgctacggaaacttccgcaggcggtgtaggcatcggcgccatcgcgacgtttctcggtgtaggaggcagcgtcatgaccgtgccgctgttgcgccgttgtggcttgagcatgtcgcaagcgacgtccatggccaatccgttgagtgtgccggtggcgttagccgggacgctgacgttcatggcgttggccgggttcagtcaggctgacctgggcgcgtggtttgtcgggtatgtggatttgctggcgtttgcggtgctgacggtgggggcgctcatcgggattcgattggctgcaccatggattgggcggattccggatcgggtacatgcctgggtctatatcgggttgctgattattgtgctgctgtgcatttcgcttaaatgaaccattgccaggttacagcggaagaaatcaaaattgataaccgaacgctgtcctccagcaatgaccagagaaccaggatgttgatcttcaattgcaccgaagccgccagcaaattcttcagccgtgttcacaagggcaaaaagatcacgccggtggacgctaatccgccgttcccaatcattgaagatgatgcgtcgaacggcgctgacgagcagtggctggtgcacgcgataacggtacaacgcaagcacgtgctgctggccattcacataaaaacccgctattgcctgattttcgctgatgcgaaaaaggctgacacagaagactttgttgatcgattcgtggatcgttgggtcaaggggatagtgatcaacgcccatcatcatggcctcgggcagtggcttaaccctgagttgatgttggcgcggctgaaacaaacttgtgagcatcaacggttctatcgacgtagccatcgcagcgcgcaaaaacacattgatgagattgcatggaacttccaggacaaggtcgcccatacggggactttgccaccggatgaagttactgcgatggtattcgacgagcaaatgaatgacacgcccaggaacagcaagggcgccaagtcttactactttccggatgaggaaatggcgcttcactggctgcgtcattactgctttcttgatgacgtccagcttcatgctgccaaggaacgtcgccaacaaatggctcgggaaattgcggcacttgagcacgaagcctggcttaaaaagtacgagcaagaaaactcgaatagttaagcggcgccggccataatccgcagcgtattttcagcgccggcgcctgtgtgccgacgcgttctccgactccttcaaggattgattcatgctcaagggactgatgcgcctggcgccatatgccgcggcgctgttcacactgatttccactgcccatgccgaagatggccgtcgcgtatttaccggcacattgggcaagacggcgattgttgtcgaactcaacaccacacagcaggacgaagtcaccggccgctatttctacgagaaatatcatcgtgacctgcctctcagcggcgcattgcaggacagcacactgacactgaccgagggcaacaatcgttacggtgatgagaagcctctgccgacgctgaaactgaaacccactgctgatggctggcagggcgagtggcaaagtccgcagggcaagaagttgtcggtgaacttggccgaagccaaacttccagcgccgacatcaacgactttgcctttcattgccacactgccgaagagcgaaccctacgagtatttgcgtttacagggactcaagctcaagcccgcgaaaacagaaaacttcatgggttataacctgcagtggtgggtcgaaccggaatcgaaaatttcgttgttcagcgtcgcgtccggctacccggcgcaagatcaactacgcatcaatcagctattgcttgagcgactttggcgagaggtcatcagctaccacgcctgcatgctgcaaggtggcgaaaatgccgagcagtatcagagtgtcgcgcccacgttcctgtcgccggacgtggtcagtctgaacatcaataccgggtatgactgtggtggcgcgcaccccgatgtcagtaactcccccgtcaacctcaatgttcacactggccaagacatgaagctgcaagacgtgttgttggttggcgagcgcgagaatacttcgactggagtaagcgccagcaatcagagcgatgtgttggcgccgtggctgatcaaacaattcacaacgctgtatcccaacgaaatgaaaaaaccagccgatggtgatgaggacagctgcgattacaccgatgaaaatgtctggagcgttttgaattggcacttcactgccaagggcatttacctgggaccgtacttcccgcgcgtacaacgtggttgcgatgaaccagagtggtcgatcctgccgtactccctcgtcaaacaacaccccggcgccgtcaaactgcaactgccccagggctaaccgttactccaaacccggcgcttcacgaataatgaagtgatccaggttctcgatattggcattgaagacctcgaaaggcttttcggggttcttcttgccgggcacctgcttcaactccggcgtcaccccatagaagaaacagaacaacgccttgtcgctatccaccgcgtgcttgatctcttccagaaacgccttgcgcttgcggtagttgtcgatcaacttcttgttcagataaacactgaccggatacggctttttcttactgtcctcgggcttcttgaaccagaccttgtcctcgaaatcgatacgaaaactggcaccgctgtggaagccctcaatcttcttgattcgaccccagtaaatcagccccttgttgtccgtcagatactcaatcttcttgaagaacgaactgtatggcgccgaatgctcgccgaccttcaacggcatccgcttgagcaactccttgtccgcgaagttggaaacaaaacactccaccggatgcgcaaacacactggtcttgtccggcgccgactcacgattcgccgactctttaccactgtccacagccacccgcaccggatcatcgcgcaacacatccgccgcccccgccggcgcgacaggcttgcgcacatactcacgcctcgtcagcaacaactctgatgggaagtgttcctcacgaccgtcatccacctcaccatccgccgtctcaacaccagatgccgaagccttcaaactcacatacggacaacccgccacatgctgcgtcgtgggcagattcttgaagtgcggtgtgcgcacgtaattcacgttcttggcgttgaacgtgcccaactcattggaagcctcgaacgccgaacgacaagcatcgttggggcactggaagtgttccttcgcggaatcgaacgccaccgtctcatcgaaattgagatcgcgaacatcatagatcgacaacttgtcgtcgaggctgaggcagtaggcgagatcgaatttcatggtggggctcggatccttgagtgggggaggggtattaatagcgggaggcggggtaggttgcactgattgttttcaggatgatgcaaaacctgtgggagcaagactgctggggattctcggcatcaatcagttttcaatactcacaccgccattgcaggtcacgcttcaccatgtagagagggagcttgcacccgttgggttgcgaagcagccccaagcattatgaggcacaaaaaatccgctgcttgaacctcaagcagcggatcttgaaaccctcagcaaccacgcaacaatcgcgaagccctacgccaccaggattcctgccgattgaacggatcctccgccaacaaacaaggcatatcccgcaatcgaatccacggctcgtcctgccagtgcaacgtactaagcgacatttgcggccagctcagaacactcaacgtcggacgctcaaccgagcgcgccgggcgagcatcacgcagggcgggcacaacctgatgagtcagccactcgcgaagctgccgatgctcaggacagtagtgataaatcagcagcgcatacacgccggactcactcaccatcatgtggtcctccgcttcgccataggtctccacgcgcatcatctgctgctgatcagcgtcgagtttacgcaattggcgctcatcaagatgtttgcccatcaaccggcccagctcatggacacagaaccacgcttggttctcaaccagaagggcgtgcaaatgggttttgttgcggacgaaacgagtaggaagaagtggttcagacatggcatgcctcctgaccaagaggcacgggattcgaacggcgggtacaacgattcaccttcatcatgaaggtttgatatccaggcatttccatttacctctggctgctttcttagggcattcgttagggtgtcgggagctaagaaacccaccagagacgggccggacatattcccctttcgggtcttgtattcgcccactcccgacataacgggatttttcgcagacgtagagaaaccgcagacgaaaaaaagccgcatgactgtcgggtgcggaggaccgctctggtttgtagagtttcttaggctcggagctgagggtagggacatcagggatggtcgtcaaccagcgacttttcctactggtcatgaggcaaaaggaaacctggacaaagacgcagagtaaattatgctgtgtttatatccagtatttgatcgccatcgaatcccgcagctgccatatccgtgtcgccacgactcacctcacggaatccaggaaatttcatttactttgaagttttgcgggctagaatggtgaccattcgtcacagctttgacccagaggaatttcgggctcatgaatctttttgaaacaccgtcttttgaatccttgagcgaaacaacctcgggttcgtacgagcctgatactcatcccgtgactgacctggcgctgctgcacaagctcttggagatctacgaccaagggcaactggccgaaattctcaacgacgtaagcccgagccactggtgccgcgaaactatcaatcgctggatcaagggaaaggcctcgccgaagctctcccatattgagttcactcgtctcaaggatctgctacccaagcgcttgaaccacaaaccttcattcacctttatcgatctctttgctggcattggcggcatcaggaaagggtttgaagccatcggtggcgagtgcctgttcacgtccgaatggaacaagtacgcggtcaagacctacaaggccaaccacttctgcgatccggttcgtcaccgcttcaatctcgacatccgctcggtcacgctttcggacaagcccgaaatcagcgacgaagaagcgtacaagaacattgatcgcgaaattcctgatcacgacgtcctgttggcaggtttcccatgccagccgttctcgcttgcaggtgtttccaagaagaactctctggggcgtaagcacggtttcgaatgtgagacccaaggcaccctgttcttcgacgtagcgcggattattgccgcgaaacgcccggctgcattcttgcttgaaaacgtaaaaaacctgaaaagtcatgacaagggcaatacgttccggatcatctgcgaagcgttggatgaactgggctacgaggttgcagatgtaaatgcgccaaagggatcagatcccaaggtcatagatgctaagcactttgtgccgcagcatcgtgagcgaatcgtgctggtcggctttcgccgtgatctcaatgttcaccaaggattcactctgcgcgatatcagcaagcacataccgaagcagcgacctagcttcggtgatctgcttgataaggatgtggatgaaaaatacatcctcacgcctaagctttgggattatctctatcgctacgctgctaagcatcgcgagaagggcaacggttttggctttggtttgaccgggccaaacgacgtggcccgtaccctgtcggcgagatatcacaaagacggttcggaaatcctggttgaccgtgggtttgtggaaaccttggacttcaatggcgagctaaatcagcttcatcgtccgcgcagactgactccccatgagtgctcgcgcctcatgggattcgacaagccaggcgaaagcaaatttgtgattcctgtctctgatacccaagcgtatcgtcagttcggaaattcggttgcggtgccagtttttgaagctgtggctcgtttgatgaaggatcggattttggccgcgaaagaaaaaactgccgacacggaacagcctcaactggagtttgctcttcctgagtgagtttttgagttttcgcgccaagcgccgaagcgcgcatgctctagaggttgaattgaatccctcttttaatgttccgatagctcatccgaaccttgaatatgtggaggccaagggtatacaagacggttgagctatcgattgcgtgggaggtgagccttggtggatatcgtggatgccgcaacacgctcccgaatgatgtctgggattaaaggcaaaaataccaagctagaagtttcgatccgcaaagcattgcatgcgcgtggctttcgttaccgtattcatgtcaacaatctccctggtaggccagatctggtgttaccaaaatacagcgcggtggtttttgtgcacggctgtttctggcatggacattcctgccgatatttcaaaataccccaaacacggccggatttttggcgcgagaaaatccggaaaaatcatctgagagataaaactcaagaatcttccctgttggcgggaggatggagggttttggtcgtttgggagtgtgcggtcaggtcacggagtaaagaaaaatttgcgctagtgattgacctcatagcggagtggctgataaacggtaatgaaaattcacaaatagatgaaaccgaatgttcaatgatcgtatcagcgactattttgaaggcgtcgcagccaaatatttgaagcctgttgatgccgatccagatacctccaatcagcatgagattggagggctagttaaggccggctttaagaaatacttgggggctcctaataaaaatcaagaatttaggtataaggctaagcaagtgtattttaccgatgaggctttagcgccagatatctgtgaaagtacggttacttggtacgactgtcgtcgtaaaaagccgttgcgcaagcctgaatttcgactttactataattctaactccgtaacggatttgtttaccgctggtgatttttttctagttgcaaagatgcgagacgatacgcttttaatggtgtgtgctccggcgggaagcactatagaaagtcagctaaaaattttattcggcttgcataacgtaaaagagacattcattcgtggggaaatggatgcggtagagttgcttctgccattgcgcttgatgttagaaagcttgggtgttgaggtaacaaaagtagaagtaggcgatgatgtctggttgcaacgcttgataacttcatttggcggcgaaagctttccaaaaacgtcagatttctccctgtatgctcggaactccttagagtcgcctgttgatcctatagtttttccagaccaagcaattgttgagtggatggatcatgaggaaaagctatttcgtatatatgagcggcatctggtgcggcaaaagcttcgcataggatttggcgaggatggagaagatgttgacgattttgtaagttactccttgagtgttcaaaatcgtcgtaagtcaagagtcggtcatgcatttgaaagacacctgtcttatatatttgagagtcatggaattaggtttgagcggggaggtgcgaagggctgttccacggaaaatagtaagaagccagacttcttatttccagggttttcggagtatcgagatccagagtatcctgagaacaaactttttatgttgggagctaagacgacgtgtaaggatcgttggcgtcaggtccttagtgaagccaaaagaataagtgaaaaacacttggtgactctcgaggcagccattagtgaaggtcagacaagtgaaatggcctctagtggattacgactggtcgttcccaagtctatgcatcatacgtattcgaagtcacaagcagagtggttgattgcgttgtcagagtttatagcgctcataaagcaggcagagggctcaggaactgcctagtttcaagcggctgatgttgcaaaaaaaatcgttgttgtaagagttgttgagcctgataacagggagtagacgcaatgagttatgagacattcgttcttgagttcgcaggtaacgatagtaaagaagatgaagggctggggcatgctggtattgagacttatcgccagcaaccgtatgcgagtgcggctagagaactggggcaaaatagtcgagatgcatattcttcacttccagtgaaaataaagttcgatctgattgaaatacctaaaaagaatattccagctatagcaaagttggataaggttgtagcgttatgtttggacgcttctctggtggagaaaaaggagaaggagagagtttttttctctgaagcaaaaaaaatacttgctctagattatgtaaaagttttgcgtgtttctgacgagaatacgactggtgcgaaaggtgctcagcgggggagcccattttattctttgcttagagcagcaggtgttagcgtaaagccagaggaaaattcgggagggtcttatggcattggaaaaaatgcggcattcgcaatttccgatctgcggacagtgttttactcaacagttttttcggatgatgcaacgggatccaagaggttccttacgcaagggaaatctatccttgtttcccatgttgatgagggacttcctaagcgtcaaataggttattggggaggtgcagattttgagccagtcagtgatcctgtcttagctccggaatggctcagaagagaaagtaccggcacatcggtatttgtagttgggtttcgggatccagcggaatggcaaagtcattttactcgttctctcattcaaaattttttcccagctattcatgatgaggaaatggagttttctatcgatggcggcaatagcgaaataaataaagatactcttgggccgttatttgatgctgaactggttcgaaaaggatcgagcaatgaaaaggatcaagggttttctgtctcttttgatttttatcgttgttatagctcagctaaaacaaagtcaaacgtctttttcatacctgagttaggtcgtgttcaagttaaagttctcgttgaagataaactgccaaaaaaaatatgtattatacgaaatggtatggttattacggataatctcagttccttcaatgagccgtttttgcgctttccgatgtataaggacttcgttgcggtagtcacatttctcgatgtgaaggggagctcttttataaagaggcttgaggatcctaagcataaagagttgtctgctgatggtttgctgaatcaggatgatcgtgacgtagcaaagcgagtgatgaaaaagttggccggtaagattcgggcggcaattaaggagcatacatttaccgagtatgaaaatgaggtgcttgctgacgaaatgcgtgattattttcctgctggctcggcgcccgagttagagcagcggaactccaataatgatgaccctgaaactatcaagtataagattgagcctcggaaaaaaagaccttccactgaggcatatactaatgttgagggcgacggtgaaacagaaggcggctttggtgatggtagaggcggtaaagtaagggaggggcgtcgaaaatatcctggggatgttgaacgtgctcgctcgaagcagtctatccctctaatggatgtcagaaatataatttccactgggggcgcctcgaatagcagaactgtttttttcacacccaccatctccgctcatgcgcttctctcaattgacgctgtagggatcaataagaatgagcgactaaatgtttcgtcggcttttggggctaatgttaaagatggggcggtgttagtagaattcatagcggggaagcgaattaagatcgatctagagttttccgagacatataaggggccgattgaaattcgcgcagcggtggatattttagaggtgtcctctaatgaagattaatgaaaaaacacgatttccacatcctgtactaagttcggaaaataacgattacttgataggtgaatttgatattcaagttgtcacggttgaagaaaagctgaccacagatcaggtgaccgtagatgtggtagtgtcgcttgcggagcagtcgttacgggagctgattgttgatggtcatgctggcgtcggcttttttgttacgtgcttggatacttactatagtcggcttgtacctattggacttgaggatcgacggttttcgtttgaaccaggggctcttgttggaagtgtaagttttttgccgatggtttgggccaagaagaatataggagaatttgatctgaccaattgtcatgccgagtttggtggtggggcaatgtctttagagatcggctccgttcttgcagttggggaggcgcaacgattaacaatcggacgggaaaaattagcagaaattgaaagtattttttctgtcgttcaagctcccgatctagaagatgatgaactactggtaaatccagactctgataaaattcaattgcttgtagcatctaacatttatcaggattttaataggtttagggggctgccacatgggaagcccatagttctgaatagtgcttttgtacctgccgttatggaagtcttagatcttcttcggcaagcttcgtccgaatatgaggggcggcgctggttcagaatatttaaggctaagtgtgattatctaggagttgatctcgaatctcccaacttgtggcgagacgcacagcggctgttgaactctccttttggtaatatcagaatgaactcgcagctatgggagggggagtgatgagattaagttatttttctgcgaaggctattgaggctctgaaaagtagtattcaaacgaatttaaaaaattatacgtccgaaggatttgacgagtttgttgatgaaccggactggactgtttctttaagtttggatgttgacctagggcctttaggtgatcttgatccatctggtactcctcaggcagaaatagaaaactctaaattagtatggcgcgctctttcagttgttaagccgagccttgcatatgaagaaggaatctggactagattaacccatgtggagtgcttgggttattcaaggcaacgctggttggaagggcttggaagtcaagaaaaaataaaaaatgcggttgaaacacatttttttgcaccaaatttaggggggcgccgtgatgataatgctctcgccagattgtggtttaacggttatatcgctaatcaaatagcgcatgatgactttaattcacttgaaacgatattaaggcgagcggacagtcggctcagttttctagagcgttcacttactgttagtcgccctgctatcgcagcgggcgttataagggcgtctgaaaaatatgattggatcaattcgacacagtctacatttcgggactttatgaaagttttgaacaaacttggagggggcagagtctttgaggttatgacggaagcggaggtggatgaatttatgactgattgtgcgttgcgtgctggaatgccatctatttagtttgtattcagttcttggtagtttggatggattaggtgtaaaaaagccccaataaattggggcttctctggctgggctcgaatcaaaactgataacagtcttttgagagttggaacttaatcccagctcaacgcaccaccagtctgatactcaataacccgagtctcaaagaaattcttctctttcttcaagtccataatctcgctcatccaagggaacgggttagtcgtccctgggtactcttctttcaaaccaatctgcgacaaacgacggttagcgatgaacttcaggtagtcctccatcatcgctgcgttcatgcccagtacgccgcgaggcatggtgtcacgcgcgtattcgatctccagctgcgtaccctgcagaatcatttgggtcgcttcttccttcatttcggcatcccacaggtgtgggttttcgattttgatctggttgatcacgtcgatgccgaagttcaggtgcatggattcgtcgcgcaggatgtattggaactgctcggcgacgccggtcattttgttgcggcggcccatggagaggatctgggtgaagccgcagtagaagaagatgccttccagaacgcagtagtaggcgatcaggttgcgcagcaactctttgtcggtgtccggggtgccggtttcgaacttcggatcggagatcgaacgggtgtatttcaggccccaggctgcttttttcgcgaccgatgggatctcgtggtacatgttgaagatttcgccttcatccatggccagcgattcgatgcagtactggtaggcgtgggtgtggatcgcttcttcgaaagcctggcgcaggatgtactggcggcattccgggttggtgatcaggcggtacacggccagtaccaggttgttggcaaccagggagtcggcggtggagaagaagccgaggttgcgcatgacgatgcggcgctcgtcgtcggtcaggccttccgggtttctccagagggcgatgtcggcggtcatgttgacttcttgtggcatccagtggtttgcgcaaccgtccaggtacttctgccaggcccagtcgtacttgaatggcacgagttggttgaggtcggcgcggcagttgatcatgcgcttttcgtcaacggcgacacgggcggaggcgccttcgagttcggcgaggccttcggcaacgtcgagggagttcagtgcagccttggcgcgggcgacagctgccgagtcgtcggcggtcacggcgcgggcttccagcgctgcggcgccgccggcgttgtcgaggcggtccatgttggcttcagtagcgtggccggcgttggcgcctttcactgctgctacttcactgtcttctttgtcgaattcgtcccagctcagcatgacgtgtcgtctcctgcgtgagggcctgtcgccccgtgtgaaacctgattggttggtttttcacacggtcgtacagaccgcgttggatctaaaggaatcgttctttgcagcagctaaacgcaggcatcaaacagaattttgtacgggtttccgagagcctctgacgggcgcaatcagtgttggacactgctgcggggcttcagaatggcttttgatccctgtaagggaatattgctgacccgattagggcggcattatagggaaaaaattgtgctcgtgggggagggcgaaagcgcgcagggcggtcgagcgggagggcgatttgagtcggagcgagggtttacagggctttcgcggatgttggcccgtgagatttttttttgattaattttttcctcaggctttggttgctcaagaaatgagcaaaaaaccgcgtttttcactatatcttgtgttttgcaacccttttgaccgactccagacacaactgagcccgaccgaagccgggctggaatcgaccctcaatgaagcgctgagagatccaattcggtgcagtctgcaatcatcaattggtgcagccgttgcccatcacgctgtaacgcaggatgtggcgctgacctttggagtcgtcgtactccattttcgctggtactacttcgcagacgttcggaatttcactcatcgatacgacgttggcgatgtccaggtgagtggagtaagtgtattcctcgatcaccggttgttgctgcgcgacatcagtcgggacctcatctgccatggcggttgcgcacagactgctgagggccagaaccaataaagctttcatttcagatttacctttttgaggtcgagtggggtcacgcaacctttatggggttgcgtgtgtaacttcatcgtttgcagttattacttgagagctggattaacggccttcgtgggggctgtatcgttgttaatcgcgtttgccttgttggcgaggtgaattttagggagaaggggcgggggtaaacagagcgggttttgataaacacctttggcagatttggtaacaatcgcttgagatggggtggtgactggattgctgggcgggtgatttgcctgggggaccgaggtgtctgattcgcttgcaggcaagctcccacaggggattggggatgtttggaggatcggtgtaagggccgcgttacgggtatctggatgttttgtaggggcttgttactaccatcgtcgaatggttctatggcccccgccccgttacaacagggtcatacaaaaacaactattacaccgaggtaggaaagatgagtgcggcttctctgtatcccgttcgtcccgaggttctggctaacacgctgactgacgaggcgacctacaaagccatgtaccagcagtcggtcgtcaaccctgacggcttctggcgcgagcaagcccagcgtctcgactggatcaaacctttcaccacggtgaaacagacttccttcgacgatcaccatgtcgacatcaagtggtttgccgacggcaccctgaacgtttcctacaactgcctcgaccgtcacctggccgagcgcggcgatcaagtcgcgatcatctgggaaggcgacgacccttccgagagccgcaacatcacctaccgcgaactgcacgaacaagtgtgcaaactcgccaacgccctgcgtggtcaggacgtacaccgcggcgacgtggtgaccatttatatgccgatgattcccgaagccgtggtcgccatgctggcctgcacccggatcggcgcgattcactcggtggtgttcggcggtttctcgccggaagccctggccggtcgcatcatcgactgcaaatcgaaagtggtgatcaccgctgacgaaggtattcgcgccggcaagaagatttccctcaaggccaacgtcgacgacgcgctgaccaacccggaaaccagcagcatccagaaagtcatcgtctgcaagcgcaccggtggcgacatcaagtggaaccagcatcgcgacatctggtacgaagacctgatgaaagtggcgggcactgtttgcgcgccgaaagagatgggcgccgaagaagcactgttcatcctttatacctccggttcgaccggcaagccgaagggcgtgcagcacaccaccggcggttatctgctgtacgcggcgatgacccacgagcgcgtgttcgattaccgtccgggcgaagtctactggtgcaccgctgacgtcggctgggtcaccggtcacagctacatcgtctacggcccgctggccaatggcgcgaccacgctgctgttcgaaggcgtgccgaactacccggacatcacccgggtggcgaagatcgtcgacaagcacaaggtcaacatcctctacaccgcaccgaccgcgatccgcgcgatgatggcgtcgggtcaggctgcggttgaaggcgcggatggcagcagtctgcgtctgctcggttcggtcggcgagccgatcaacccggaagcgtgggattggtactacaagaatgtcggcaagtcgcgttgcccgatcgtcgatacctggtggcagaccgaaaccggcggcaacatgatgagcccgctgccgggtgcgcacgcgctgaagccgggttcggcagcacgtccgttctttggtgtggtgccggcgctggtcgacaacctcggtaacatcatcgagggcgaggctgaaggcaatctggtgattcttgattcgtggccaggtcaggcgcgtacgctgtatggcgatcatgatcgtttcgttgatacctacttcaagaccttccgtggcatgtatttcaccggtgacggcgcgcgccgtgatgccgatggttactactggatcaccgggcgtgtcgatgacgtgctcaacgtgtccggccaccgtatgggtacggccgagatcgagagtgcgatggttgcgcatccgaaagttgccgaggctgctgtagtcggtgtgccgcatgacatcaaggggcagggcatttatgtctatgtcacgttgaagaatggtgaggagccgaccgagcaactgcgtctggagctgaagaactgggtgcgcaaggagatcgggccgattgcttcgccggacgtgatccagtgggcgccggggttgccgaagacccgttcgggcaagatcatgcgccgcattctgcgcaagattgccacggcggaatacgatggcttgggggatatctcgacgctggcggatccgggtgtggtgcagcatttgattgatacgcacaagaccatgaatgttgcttaagtagcaggtctgagaagaagaaagccccgtccggttttgccgggcggggcttttttgtgtctgggggttttgtggtggttgggctggcctcttcgcgagcaggctcgctcccacagtttgaccgagtaccttcaggcaaaatgcagatccctgtgggagcgagcctgctcgcgaaggcaatttgtcagacgccggggtagtccgctgtcggaacgcggactcacccaaccaataattatcgatctcccccgtaagacatttcccgctgttacccaacaccttccacgtaaccgaatgtgtaaccgcccgccccgcggcggggcgtagggaaacgcatcgccccgttttagagcctcaaaagccccgctgaaaaataagacccaacgctgcgcttgccggattagaagggtttgcgaataataggcccgcaatttgcagcatagatcggttcactgtctttcgctcttgcatgaaattgcagggctgtcaatgtgccaaagtcgctttctctgtgcatctgtaattagttgtcgcattgaagaaatatcggcttcgggcctgtcgttagaatgccgatcactcgctcatcgtggctgacgttgaaacctgcgacggtttcaatgggaaatttcccaccgatgcagcaaccgatttcccgattcacccattcgcatattgggctgtcgctcactctgccgtttttgccctttaccgatggagtcccaagatgaagaaacttgtgctgcttggcgccctggcactgtccgtgctgtcgatgaatgccttcgctgacgaaaaacctctgaagatcggtatcgaagcggcttaccctccgttcgcttcgaaagcgccggatggcagcatcgtcggtttcgactacgacatcggcaacgctctgtgtgagcagatgcaggtcaaatgtgtgtgggtcgagcaagagttcgacggtctgatcccggcactgaaagtgcgcaagatcgacgcgatcctgtcgtcgatgtcgatcactgaagatcgcaagaagtcggtcgacttcaccaacaagtactacaacaccccggcacgtctggtcatgaaggccggtactcaggtcagcgaaggtctggctgagctgaagggcaagaacatcggcgtacaacgtggttcgatccacgagcgtttcgcccgcgaagtcttggcgccactgggtgcagagatcaagccatacggctcgcagaacgaaatctacctggacgtagctgccggtcgcctcgacggtaccgtggctgacgctaccctgttgcaagacggcttcctcaacaccgacgctggcaaaggcttcgcgttcgcaggcccggcgttcaccgacgtcaaatacttcggcgacggcgtgggcatcgctgtgcgtaagggcgacgccctgaaagacaaaatcaacactgccatcgcggccatccgcgaaaacggcaaatacaaggcaatccaggacaagtacttcgccttcgatatctacggcaagtaacacgtctctgcgacaagtccgaaatggcgcaagcaacaggatctctgcggtttgcgccattttttcatcccaactttcgaggacctgaatcatgttgaaaggctacggggctgtcatcctcgatggcgcatggctgacgcttcagctcgccttgtcgtccatggctctggccatcgttctcgggctgatcggtgtcgcgttgcgcctgtcgccggtgcgctggctggcctggctgggcgatctgtattccacggtgatccgcgggattcccgatctggtgctgatcctgctgatcttctacggcggtcaggacttgctcaaccgcgtcgcaccgatgctcggctatgacgactacatcgatctgaatccgctggccgccggtatcggcaccctcggtttcatcttcggtgcgtacctgtcggaaaccttccgtggcgcgttcatggccattcccaaaggtcaggccgaagcgggcatggcgtacggcatgagcagttttcaggtgttcttccgggtgatggtgccgcagatgattcgtctggcgattccgggcttcaccaacaactggctggtactcaccaaagccaccgcgctgatttccgtcgtcggtctgcaagacatgatgttcaaggccaagcaggcggcagatgccacccgcgagcctttcaccttcttcctcgcagtggcggcgatgtacctggtgatcaccagtgtttcgttgctgatcctgcgtcaacttgagaagcgctactcggtaggcgtaagggcggctgatctatgatcttcgactacaacgtcatttgggaggccatgccgctgtacctcggcggcctgctgaccaccctcaaactgctcgcgctgtcgctgtttttcggtctgctcgcggccctgccgctggggctgatgcgcgtctcgaagaacccggtcgtcaacggcgccgcgtggctttacacctacgtgatccgtggcacgccgatgctggtgcaactgttcctgatctactacggtctggcgcagttcgaagcggtacgcgaaagtatcttctggccgtggctgtccagcgcaacgttctgtgcgtgcctggcctttgcggtcaacaccagcgcctacaccgctgagattatcgccggcagcctcaaggccacgccgaatggtgagatcgaagcggccaaggccatgggcatgtcgcgcttcaaactgtacaagcgcatcctgctgccgtcggccctgcgccgggcgctgccgcagtacagcaacgaagtgatcatgatgcttcagaccaccagtctggcttccatcgtgaccttgatcgacatcactggcgcggcgcgcacggtcaacgcgcagttctatctgccgttcgaggcgtacatcaccgctggcgtgttctacctgtgcctgacgttcattctggtcaagctgttcaaactggccgagcgtcgctggttgagctacctggccccgcggaagcactgatatggaacgcatcgaccacgtattgccgtggagccatctgggcagcgagcgcaagatttcggtgttccgcttcggccatggcgagcgcaaggcctacattcaggccagcctccacgctgacgaattgccgggcatgcgcaccgcctgggagctgaaaaagcgcctcggtgaactcgaagccaaaggcctgctcaacggtgtcatcgaactggtgccggtcgccaacccgttggggcttgggcagttgctgcaaggcaatcaccagggccgtttcgaggccggtagcggcaagaatttcaatcgtgatttcgttgagctgagcgcgccggttgcggcagcattggctgatagccttggtgatgatccgcacgccaatgtgcgcctgatccgtcaggccatggccgaccatctcgccgcattgcccgaggcgagcagccagttgcaaggcatgcagcgcgtgttgctcagccatgcctgcaccgccgatgtggtgttggatttgcactgtgatgctgaagccgcgctgcacatgtacgcgttgccgcagcattggccgcagtggcgttcgctggcggcgcatctgaatgtgaaggtcggattgctggcggaagattccggcggcagctcgttcgatgaagcctgttcgctgccgtggttgcgactatcgcgacagttacccgatgcgcagattccgttggcgtgtctggcgacgacaatcgaattgggcggtcaggccgataccggtcgcgctgaagctgaagcgtatgctgaaggcattctcgcgttcctcgccgagcaaggcctgatcactggcgagtggccgaacccggcgcacgaagcctgtgaaggcatgccgttcgaaggcactgaattgctgctcgcaccgcaccctggcgtggtgagttttctgcgcaagcccggcgaatgggtcgaggcgggcgacgagatttttgaagtgattgatcctgtgtccgatcgggtcagcacggtgtgtgctggtacctccggggtgctgtttgccattgaacggctgcgttatgcccaacccggtttctggctggccaaggtggcggggcgcgaagcgctgcgtcacgggcgcttgctcaacgactgactgactgtttttgtgagaaccgaccgcatgtacaaacttgaagtccaagacctgcataaacgctatggcagtcacgaagtgctcaagggcgtgtccctgaaagcggcagccggcgatgtgatcagcatcatcggctccagtggctccggcaaaagtactttcctgcgctgcatcaacctgctcgagcagccgcacgcgggcaagattctgctcaacaacgaagagctgaaactggtggcgaacaaggacggcgcgctgaaagccgctgatccgaagcagctgcaacgtatgcgttcgcgcctgtcgatggtgttccagcatttcaacctgtggtcgcacatgactgcgctggaaaacatcatggaagcgccggtgcatgtgcttggcgtgtccaaggccgaagcccgcgagaaagccgagcactacctgaacaaggtcggcgtggcccatcgtaaagatgcgttcccggggcacatgtccggtggtgaacagcagcgtgtggcgatcgcccgtgcgctggcgatggaacctgaggtgatgctgttcgacgaaccgacttcggccctcgaccccgagctggtgggcgacgtgctgaaagtcatgcaagcgctggctcaggaaggtcgcaccatggtcgtggtgacgcacgaaatgggctttgcccgtgaagtgtcgaatcaactggtgttcctgcacaaaggtgtggttgaagaaagcggcaacccgcgcgaagtgctggtcaatccgcaatcagaacgtttgcagcaattcctctcgggcagtctcaagtaattcagggctgccggtatgcaccggaatagtgcatgcttcgcaacctgaaggctgactccattccactgtaggagctgccgaaggctgcgatcttttgatctgtttttgaggatcaaaagatcgcagcctcgttttactcgtcagctcctacattgggataagtattccagtcccgatggtggatctgcgtcaggctcaagatttgtgttcattttcgggctagcattggcccttgccttcatcactgttcttcgcttcggattgcccgcccatgactgcccatcgaattggtttcctgatttggcccagcactaaagcgttgacgctggcgctggcggaggaggccttgcgtgttgctcagcgtgtgcatccggacgtggtctacgaattgtccttcctgcaggccgagccgccggccgaaggtgcctggcaattgcccggtgaagcgtggaccggcaagctcgaaaatttccagaaactgttcctgctcgctgacgagccgccgaccacgctggcgccggcactcagcagcgcactcaagcaactggtgcgtgcgggtacggtcatcggcggtctgtccgctggtgtgtacccgttggcccaactcggcttgctcgacggctatcgcgctgccgtgcactggcgctggcaggacgatttcgccgagcgtttccccaaagtcatcgccaccagtcatctgttcgactgggatcgcgatcgcctgaccgcgtgcggcggcatgtccgtcctcgatctgttgctggccgtgctggcccgcgatcacggtgcggaactggctggcgccgtctcggaagaactggtggtcgagcgcatccgcgaaggtggcgagcgccagcgtatcccgttgcagaatcgtctcggctctagccatccgaagctcacccaggcggtattgctgatggaagccaacatcgaagaaccgctgaccaccgacgaaatcgcccagcacgtgtgcgtgtcccgtcgtcagttggagcggatcttcaagcaatacctcaaccgtgtgccgagccagtactacctggaattgcgcctgaacaaggcccggcagatgttgatgcaaaccagcaagtcgatcatccagatcggcctctcgtgtggcttctcttcggggccgcacttctccagcgcctatcgcaacttcttcggcgccacgccgcgggaagatcgcaaccagcggcgcagcagcagcccgttcgaattgtcgtcggtaccgccagagcgcggttgacagaccttgctcggcgagcaggttgatcactcgtcgatctcggaatcttccgacgtcgacacttcgagttctgcccggttgatgaccacctccaccccaaagtccacacgatagttccggaagtaagcgagcaggcgctgcacgctcgcttcggagaatgggttgttgcgcagattgatcttctcgccgcgttccgctggcagttcgaggatgtcactggggacgtcagtgattgcgttgtcgttcagtgccgccagatccaattgctcaagctgcagcaggcccgatggcagcgtggtgatcccggtgttgtcgagcagcagtcgggtcatttccgtcatctgactgacgtccggtgcttcgcccaaggggttgtcgctcaggtcgagatgttccagccgatgcatctgcgcaagctcgacaacggcctgtggcgtgagcgtgatgtggcactccgagagcgacagatgagtcagatcggccattcgaaataccgcgtcggggatctgctcgagttgatactggcgaactgtcaggccttttagtttgggaaacgtctgtagaaatctctcgatgccggatgtccgtcccggtctgcttgtcatgtagagatgtgatacatggctgaagtcggcgtcgagttcgggcagttcgccgttgatggtggaggtcaggttcaagtcgtgggtcggttcgttgtcctgatcgaagtcatcttcatccatctcccgtcgccagctctgctccagaatgcttttgaattcatgccgcgacgcgtgctcgctcagcacttcttcaagcgtgaagggttcaccactgatcgggtggagtgcaggcaggtcggttacccaagtcgcgagtccggagctcaagctgctgaattcgttctcaaggcgcgcaatttcgtttcgtccttcggccagcgtcccgggcaacaggtaaaagaactcgctggcctgctcctgatccaggtgcgtgtacaaagcttgcacgcgttgcaggtcggccggttcggccaaaacgcccaagtcctgccgtgtttcgttgaagcgacgtttgattcgttcgcggtcggtcacactgatcggattgccgccaagatcgaagccgtccgacgtactgtcgggcagttcgaagagcgctgcgggcagcgcgtgaatctggttgtcattgagcaaggcggtttgcaattttgggcggctcagcaggccgctgggcagttcggaaatgccggtttccgagacgtcgatgtaattcagtccgggcatccgttctacattgggtgtgagtccgagcgggttccggaacaggtcgatagttgtcaacttcgtcagtttgctcaggctttccaggctttgcggtgtaagggttatgccgcaatcggagagtatgagttcttgcagctgaggcgactgattgattgcctccggcaggttgccgaggcgaaagccgcgcagggccagtcgatgcagatccgtaaagcagcggaggaattgatgcaggccttgagtgttctcggcgccctccatggtcaggtggtcgacatggctgaagttgacttcgagcgccggcagttcgccgatgatcggttgagccaggcgcaaatcgatcatgtgctcggagtccatcggcagcgagacttgctgtttccagcaatccagtaagtcgacccgcatctgccggcgccgaattcgctgaatggcatattgctcggtagtgagtggggcgccggtttcggggtggacaacagggatcgcattcacccagggattcagaacttcgtcgagccgacctcgttcgataaacaatcggttcaattccccgcgtggcccgcttggatgacgttgcaagcgctcgacaaaagcctccagttcttcgggcaacagatgcggcagcagccggtgagcatgggattgcaaagtcggagtgttggtgggcatgcgtcggaaaccggtagtgccgccgagcagacgcatgacgcttgggtcgtaggcgggtttgcggttcgggttttgcgagagcagggtcagcagctcgtctcggttcagggagtgttggcgaatcagcagattgagtttttcactttcgccgatgccaacgttcagtgccagccgctcggcatcaggcaaggcttgcagcagattgaaaagcagggggccaggagcactaagctgttcaccagcatcgtcaaagggttggtattgtccctgttcggtcagcaccaacactttgcgagtggtggcgtccagcgggccaatgctgtcgatcagggggccggagtgtgcgtagtgtctgacttccaggcgcaatgattgcgaccagcctggcagcctcggcagcgagtgcattatcagtcgatcagtatccagattgtcctgcgtggcttttagctccagcccctccaaagcacgcgtcgcacgcacctgcaggccgatctcgcgggtaagctcggcgagccggcggggcagtactgtgtgctggagctgttcgcgttcgaaatcgctagtcgtttcaagaatggattgcgcgaggggctttggcagccccggttcggcatccatcagcacctgaaccaagggggcggcgttgcgttgcaggctgcgatatttatcctcgaacaggctttgccttttgcggtgcgccagttcagcaatccgtcggcgcaaagtccgggtgcggctctcaagcgtcggcggcgaggtatggggtttttcgcccagtaacgtttttgcatcgacttccgacaagcgcagcagacaggtcttgagcagattaccggcgtcgagtcttgaggcatcaatctgtagaagcgggacgtccaccgtgggtgtttgccaaagtacctttcctttgcgaccaaccaggcgcacacctttgtcggcaggccagtcgccgctctcatgtagcagtttcagttggatgaccggatcggcctggaggtaatcttcggcgcgttcgctaccgatctgctcgatgaatgtctgaatgtccgcgtccagatgccagcgcagcaaggtgtcggccagcagaggcggcatctgcccaagttcgacgtgcattttgcgcaaggcattttcctcgcagccactgatgtccagcaggcgctcctgcagactgagcggcagttggcgcatgtgcggatcgctacggctcaacagcgtcttgcgttcccagtccagcggctgatcgagttcggtttgccagactccggcctggttgtgcttgagttcgggtttataggcttcggggcgaacggggtggtcgatgcggtattgcgctgacgggctgtcctggctgaccgcgtaaagtttgtcttccagagccagcagggttttaccttgatgagcatgcaagcccagcgcatcgggttttgcatctttgggcagggaggtggcctgctcgtaaaggtgcaggtcgggttgccagtaccgtgaggtgccattcggcagtgtcgccggggtgagccggtcaatgaacgcaatcactgattccggcagtagcgtgcgaaactggcttgccgcgatgaccccgcctgctgcgaaagcaccgacctggacgacggattccaccgcgtccatgaagtgttcgaatgcctcgcgggacgcgccttgcgcccaatcgacgatgccttcaaaggtttcgtcgagcagttgataggcggtatacgccaacatcagctcgccgagaaatggcacgaatggcaacgcgatgaaggcgacaatgttgagcagggacgcagccacttcgctgaacgaatcccagagcgcccagcgagcctgacagtcgaccgctgccgtggagacggagacaacccgtgcatcgttgagaattttgtcgagttttcgttggtagagataaacccacaagtcgcctttgatcgttgttgcggccatttgcagaggcgcgcgttcgactggattctcgcgccaggtggggcgcggatcaccgttggaaaccggttgccaggtgatcggcagaaggcgattgttcaactggccgaagaaatgcccacgatcctcatgattgatgaaccgactgaaaaaagattgatagtcctgatctcgcaggcgttgtgtcaggtgccgggcaaactcgccggtgctggggtattccctgatcggatgctccgggtcatccggaatgtagaccaccactcttgatgtcgtgtccgcactctcgaggttgggagcgaacagcacgataccggtcagtcgggcgttcatgattgtcagcgcatgacattgccaggactggcgattcaggcgcagatacttcaagccatcgagcaagccgagaatcagccggtggatatcgccgctcagcagtttttgcatgtaggccatttgcagcgccgttatcagggccgctttgtcactggctttgacattggtttgcaggatcgctgcgactacgggattgctgatgccgaggttgtcttccagataacttttgtagcgctggccaatgtccagatcacggcacagtttcgtaaaggccgggataggcattttttcgcgaatctttggcaacgcgctgaactgtccctcgggtgtagggcggctgatataggcggaggtggtttcgaaggcgtcgtccgtggtttcgcggctttcaaagttatgcagtgcggcgtccaccaaggcgaccgtccaggtgcgcgcggcgcccgacttgagccctggcaacggcgcatgcgcagggatgtaaaggcgcatgaagatttgcctgacatcgaggttcagcccgaaatgtttttctatctcgacacccagcaatagttcggcgaaggaccgggcatccagcaggcgtgcgaggttttgctcgacgcggttttgcgcagcccactgcaatgcattgagcgcgcgcaatttctcgtgctctttgcgtggtgcttgcaggagcggggcggaaagttgtggcgtggtttttttcagcgcatcgcgcctgtgggtcggcgcctggctgagccacggcgcaatggcatcgagcagaggttgatagtgcctgtcgggcttgggcagcaacgctgagtcggatggcgatgcgtggagggctggattttcatcagtcataagagcggccgtttgccttggaaagttccatagcaaaccctgggaaacgcatcgatgtgcggtacatatataccgcacaacgaaaaacactcttgagtaagatctccagcagtcctgcgcaaacggcggcgtgcagtttaaactgcgcctttgcgacgctatatgtcgcattgccgtaaacccgggaaaatccggggtttgcgctataagaagttgtcgcttggcggcaaggccgggctgaaaactgtccttacaatcctcaccaagctcgccagtttcaggcgagtgcttctcatcaggagactccgatgtccgttgagcacgctgcggtacaacgcgccgatttcgaccaggtaatggttcccaactacgcgcctgccgctttcattccggtgcgtggtgccggttcccgcgtctgggatcaggccggccgcgagctgatcgacttcgccggcgggattgccgttaacgtattgggccacgcgcatccggcgctggtcggtgcactgaccgagcaagcgaacaagttgtggcacgtatccaacgtgttcaccaacgagccggccctgcgtctggcgcacaagctgatcgacgccacgttcgccgagcgcgtgttcttctgcaactccggcgctgaagccaacgaggccgcgttcaagctggcccgtcgcgttgcgttcgaccgtttcggcactgagaagtacgaaatcatcgccgcgctgaacagctttcacggccgtaccctgttcaccgtcaacgtcggtggccagtcgaagtattccgacggtttcggtccgaaaatcaccggcatcacccacgtcccttacaacgatctggcagcgctgaaggcagcggtttccgagaagacctgtgcggtcgtgctggaaccgatccagggtgaaggcggcgtgctgccggccgagctggcttacctgcaaggtgcccgcgaactctgcgacgcgaacaacgcgctgctggtgttcgacgaagtgcaaaccggcatgggccgcagcggcaagctgtttgcctatcagcattacggcgtgaccccggacatcctcaccagcgccaagagcctgggcggcggtttcccgatcgcggcgatgctgaccaccgaagcgctggccaaacatctggtcgtcggtacccacggcaccacttacggcggcaacccgctggcgtgcgcggtcgctgaagcggtgatcgacgtaatcaacacgccagaagtgctgaacggtgtgaacgccaagcacgacaagttcaaggcgcgccttgagcagatcggcgagaagtacggcctgttcactcaggtgcgtggcctcggtctgctgatcggttgcgtgctgaacgatgcctggaaaggcaaagccaaagacatcttcaacgccgctgaaaaagaaggcttgatgattctgcaagccggtccggacgtgatccgtttcgccccgagcctggtggtggaagacgccgatatcgatgctggcctggatcgtttcgagcgcgctgccgcagcactgacgcaagcctgatagacccttcgacgcctggagtttttcaggcgtcgatcacaattttatgccggaccagatcaactgtaggagtgagcctgctcgcgattgcggtatgtcagtcgactcattggtttctgacagaccgcaatcgcgagcaggctcactcctacattgatctccatgtaggcccggttattttttctgtaagttctgagattaaggagtgacaccatgctggtgatgcgccccgcgcaaatggctgatctgggcgaggtacagcgtctggctgcggacagcccgattggtgtcacttccttgccggatgacgtggaacgtctgagcgacaagatcgccgcgagcgaagcctcgtttgctgccgaagtgagcttcaacggcgaagagagttatttcttcgtcctcgaagattccgcgactggcaagctggtcggctgctcggcgattgttgcttcggccggttactcggagccgttctacagcttccgcaacgagaccttcgtgcacgcctcgcgcgagctgaagatccacaacaagattcacgtgctctcgcagtgccacgacctgaccggcaacagcttgctcaccagtttctacgtgcagcgcgagctggtcggttcgccgtggtcggaactcaactcccgtggccgactgctgttcgtcgccagtcacccggagcgtttcgccgactcggtagtgaccgagattgtcggttacagcgatgaaaacggcgactcgccattctgggatgctatcgggcgcaacttctttgacctcaactacgccgaagccgagcgcctgtgcgggctgaaaagccgtacgttcctcgccgagctgatgccgcattacccgatctacgtaccgctgctgccggactccgcccaagaggcgatgggccaggtgcacccgcgtgcgcagatcaccttcgacatcctgatgcgcgaaggcttcgagactgatcactacatcgacattttcgacggtggcccgaccctgcatgcgcgcgtttcggggatccgttcgatcgcccagagccgcgtggtgccggtgaagatcggcgagccggtgaaaggtgccgggcgccagtatctggtggccaacgcgcagttgcaggattaccgcgcggtgttgctggagctggattacgcgccgggcaaaccggtgactctggatcttgaagcagccgaagccctgggcgtcggtgaaggtgccagcgtgcgccttgtggcggtttaacgccttagcgagtttcacgggtggcgaaggcggcccgtttgaggagatagcatgattgttcgtcccgtacgcagcagcgatttagccgctctgatcgacctggcccgcagcaccggtaccggcctgaccaccttgccggccaatgaagaacgtctggcccatcgggtcggctgggccgagaagacctttcgcggcgaagccggtcgcggtgatgcggactacctgttcgtgctcgaggacgacgacggtcgcgtggtggggatttccgccattgccggcgctgtcggcatgcgtgagccttggtacaacttccgtgtcggcctgaccgtcagcgcttcgcaagagctgaacatctatcgcgagattccgacgctgtttctggccaacgacctgactggtaattccgagctgtgctcgctgttcctgcacgccgattaccgcagcggtctcaacggtcgcatgctgtcgaaggcgcggatgctgttcattgctgaattcccggagctgtttggcaacaagatcattgccgaaatgcgcggtgtctccgatgacgccggccgttcaccgttctgggaaagcctcggtcggcacttcttcaagatggagttcagccaggctgattacctgacgggtgtcggcaacaaggctttcatcgctgagctgatgccgaaattcccgttgtacacctgcttcctctcgccggatgcgcgcactgtgatcggtcaggttcaccccgataccgagccggcattgtcgatgctcaagggcgaaggcttcagctatcagggttacgtcgacattttcgacgcagggcctgccatcgaatgcgaaaccggcaagatccgcgcggtgcgtgacagtgaggcgctggtgttggccgtgggcacgccgggcgatgacgccacgccgttcatcattcataaccgcaagcgcgaagactgccgcatcaccgctgcgccggcgcgtctcgctgccggcacgctggtggttgatccgcagaccgccaaacgtcttcaactcaacgcgggcgatcaagtacgcgccgtggcgttgtccgctgcacgggagtcgaaataatgaattcgctatacatcgcaggcgagtggctggccggtcagggcgaagctttccaatcgctgaacccggtgacccagcaagtgctgtggacgggggagggcgccacggctgctcaggttgaatcggctgtgcaggctgcgcgtcaggcgttcccaggctgggcacgtcgtacgctggacgagcgcatcggcgtgcttgaggctttcgccgcgtcgctgaaaaaccacgctgacgaactggctcgcaccattggtgaagagaccggcaaaccgctgtgggaagccgcgaccgaagtgaccagcatggtcaacaagatcgcgatctcggtgcaaagctaccgcgagcgtaccggcgagaagagcggcccgttgggcgacgccactgccgtgttgcgccacaaaccgcacggcgtggtcgcggtgttcggcccttacaacttccccggccacttgccgaacggtcacatcgtgccggcgctgctggcgggtaacagcgtgctgttcaagccaagcgaactgaccccgaaagtcgccgagctgacggtcaagtgctggatcgaagccggtctgccggcaggcgttttgaacctgctgcaaggtgctcgcgaaaccggcatcgcgctggcagcaaacccgggcatcgacggtctgttcttcaccggttcgagccgcaccggcaaccatctgcaccagcagttcgccgggcgtccggacaagattctggcgctggaaatgggtggtaacaacccgctggtggttgatcaggtcgcggatctggatgcggcggtttacacgattattcagtcggcgttcatttctgccggtcagcgttgcacctgcgcgcgtcgtctgctggtgccgcaaggcgcgtggggcgacagcctgctcaagcgtctggttgaagtgagttcgaccattgaggtcggcgcattcgatcaacaacctgcgccgttcatgggttcggtaatttcccttggcgccgcgaaagcgctgatggacgctcaagaacatctgttggccaacggcgcggtgtcgctgctggaaatgactcagccgcaggcacaagccgcattgctgaccccgggcattattgatgtgaccgaggttgccgagcgtccggacgaagaattgttcggcccgttgctgcaagtgatccgctacgttgattttgaagcagcgatcgctgaagcgaatgacactgcttatggtctggccgcaggtttgttgtcggattccgaagcgcgttatcagcagttctggctggaaagccgtgccggcatcgtcaactggaataaacaactgaccggtgctgcgagcagcgcgccgtttggtggtgtcggtgcctcgggcaaccatcgcgccagtgcctattacgcagcggattactgcgcgtacccggtagcgtcgctggaaaccccgagcctgactctgccagcagccctgacacccggcgtgaagatggtgtaacggccatcgcgagcaggctcactcctacaggatttgggtcgtacacaacatatgtgttcaccactaaacctgtaggagtgagcctgctcgcgatagccgcgacgcggtctgactgaattgttacctgaagcctataacaacagattctcgtggagcctcgctgatgaaatcctatgaagtcaattttgacggtctagtggggccgacccataactacggtggtctgtcctacggcaacgttgcctcccagagcaacagccagcaatcttcgaatccgaaggaagcggcgctacaaggtctggcgaagatgaaggcgctgatggaaatgggctttcagcaaggcgtgctggcgccgcaggaacgtccggatgtgggcgctctgcgccgtctgggtttcagcggcaccgacgcacaagtgatcgagcgcgctgccaaggaagccatgccgctactggtcgccagttgctcagcgtcgagcatgtgggtggccaacgccgccacggtcagcccgagtgccgacaccgctgacggccgcgtgcatttcaccgccgccaacctcaattgcaaatatcaccgcagcatcgagcacccgaccaccagtcgcgtgctcggcgcgatgttcgccaatcagcagcacttcgcccatcacgccgcgttgccggcagtggcgcaattcggcgacgaaggtgcggccaatcacacacgtttctgtcgtgagtatggcgaggcgggcgtcgagttcttcgtgttcggtcgcagtgccttcgacaaccgtttcccggcgccgcaaaagtacccggcgcgccagaccctcgaagcgtcgcaagccgttgcccgtctgcacggcctgcgtgacgaaggtgtggtctacgcccagcaaaacccgaacgtgatcgatcagggcgtgttccacaacgacgtgatcgccgtgggcaatggcgaggtgctgttctatcacgaggacgccttcctcgacaccgactcgatactggccgagctgcaaagcaaacttgccaaggccggcggcaacttccagtcggtgtgtgtgccgcgttcggcggtcaccgtcgatgacgcggtgcgctcgtacctgttcaacagtcagttgctgtcgcgccctgacggttcgatgctgctgatcgtgccgcaggagtgccaggccaacgagcgcgtctggacttatctgcaagagctgaccagttccggtggactgatccgcgaagtgaaggttttcgacctcaagcaaagcatgcagaacggcggtggcccggcgtgcctgcgtcttcgcgtcgcgcttaacgaaaccgaactggcggcggtcaacccaggggttatcatgacggcaccgttgtacggttcgttgaccgcatgggttgaaaagcactaccgcgaccgcctgagcgaaaccgatctggcggatccgcaattgctgcttgaatgccggacggcactggatgaactgacgcaaatccttaaactgggcgcggtttatccattccagatcaattgatggccggcgcgacgcctgaacgcgacgcgcggcttgtctcccccaagagagtaaaaacatgagcgattccctgcagctgatccttgaagacaccgacggcacgcaactgcaaacctcgtgcacccgcgtcgcggtcatgtggcaaggcaaagagctgtggatccagcaggacggccgtggccagttgctgatcggcgtggacgttgaagaaggtgacgccgagtacgccaacctgctgctgcgcccattggcgactaatctggtaagtctgcaactggaaatggaaccggctgacgtcggcgacgatgaagaccacgtgcacggcccggattgcaaccacgaccactaaggaaaccgctctatgctcgccctcggcaaactgcttgaactgaccctcgccggccgcgaaccggcggagaagactcaactgactgtcgaaggcgtgcgtatgcgctggttgagcgaaggtgcgctggaagtccggccaccacaagcgcgcgacaatggcctggacctgctgctttcagcggggattcacggcaacgaaacagcgccgatcgagttgctcgatcggctgctgcatgacatcgctcgtggcgatctgaagccacgcgcacgcattctgttcctgttcggtaacccggaagcgattcgcaaaggcgagcgttttatcgagcaggacgtcaatcggctgttcaacggccgtcatgaacaaagcagtggctcggaagcgttgcgagcctgtgagctggaacggctggcggcgagttttttcagcctgccggatcgccagcgcctgcactacgacctgcataccgccattcgcggttcaaagatcgagcagtttgccctgtacccgtggaaggacggtcgtcagcattcgcgccttgagctggcacgtctgcgtgcggcagggatggaagccgtactgctgcagaacaagccgtcaatcgtattcagctcctacacctacgacaagctcggtgccgaggctttcacgctggaactgggcaaggcgcggccattcggacagaacgacggagtcaatgtctcgctgctggaaacccgtctgaagcagatcatcgaaggcactgagccggaaatggctgaagcgcaactggacggtttgcagctatttagtgtcgcgcgggaaatcatcaagcacagcgatgcgttccgcttgaacctgccgcaggacatcgagaacttttcagagttggaggtgggttacgtcctggctgaagacttggccaatacccgctggatcatcgaagagcagggcgcacggatcatcttccctaatcccaaggtcaagaacggcttgcgcgcgggcatcctgatcgtcccgaccaccgacgaaaacctcgcctgaccctacgcaaaacccctgtaggagtgagcctgctcgcgattgcaatgtatcagtcgctacagtggtcgactgacactccgctatcgcgagcaggttcactcctacagttttggttccgtgtttacacggctaccgcatgcggctcggtgcggcgcagtgcgcgaaccttgcgcagcgtatccgcgcaagtgcgcgccgcttcctggcctttatgcacaaagtgctcaaagaagaacttctgatgttcgtcgccagcatggaagtgatgcggcgtcagcgacaccgagaacaccggcacttcagtttccagctgcacctgcatcaggccactgaccaccgattgggcgacgaactcgtgacggtagatgccgccatccaccaccagggccgcggcgacgatgccggcataacgaccggtcttggccagcaacttggcgtgcaggggcatttcaaaggcgccgccgacttcgaagatgtcgatgtccgattcctgataacccagggcaatcatttcggcgacgaagcctttacggctctggtcgacgatttccttgtgccagcaggcctggatgaacgcgacgcgctcgccatgagggtgtttgcttttgctgtcgatagcggtgggttgcatgttctgactcctgtttgtgtgaaaaacagggcgttatgaatcgaaagggattcaagggtgcgcacacgcacaacatcgcgcggacggccctttggcgttaatcccgttctctcttcatccggactatgaccgtcggccccggaatcacaccgggtctgctgaccttgccgtcgatcacaaccgaagtcgtgttcgccgccaagcgctcgcgggctatgcgcattgcgcgcaattaccgccggtggggaattgcaccccgccctgagaacgtttttgccgccctttctcgggcggcgcagcgtttttatcacagattgtgtgtctgtgcattgcgcctttctgatgattgtcatcgaattttttgcaggcccgaaacgacttttccttgcgcaaggcttgattaatccatgcgatgaccgcagtaatcccacttcgtaaagggatttcccctgctgacttgaggccaggttcatgagcgttatcgatcttcgcagcgacaccgtcacccaaccgacccccgccatgctcgacgcgatgactgcggcggacaccggtgatgacgtgtacggcgaagatccgacggtcaatcgtctggaagtagaactggccaaacgtttgggcttcgccgcagcgctgttcgtgccgactggcaccatgagcaacctgctgggcttgatggcgcactgcgagcgtggtgatgaatacatcgtcggccagcaggcgcacacttacaaatacgagggcggtggcgctgcggtgcttggctcgatccagccgcaaccgctggaagtgctggccgacggttcgctggacctggatcaggtcgcggcagcgatcaaaccggatgacttccacttcgcccgcactcgattgctggcgctggaaaacaccatgcaaggcaaagtgctgccgctggaatatctcgcccgggcgcgccaatttacccaagagcacagcctgcagttacatctggatggcgcgcgtctttacaacgcggcggtcaaactcggggttgatgcgcgggaaatcacgaaacatttcgattcggtgtcggtgtgtctgtccaaaggtctgggggcgccggtgggttcggtgttgtgcggctccgagcaactgatcggcaaggcccgccgtttacgcaaaatggtcggcggcggcatgcgtcaggccgggttgctggcagcggcggggctgtacgccctggatcacaacgttgaacgtctggccgacgaccatgccaacgcgcagtttttggccgacggtctgcgtgaagcaggtttcatcgtcgaacccgtgcaaaccaacatggtttatgtgcaaatgggcgacaaagccgaagcgatcaaggcgtttgctgccaatcgcgggatcaagttgagcgccgccgcacgcctgcgcatggtcacgcacatggacgtcaatcgctcgcaaatcgagcaagtgatcgcgacattcgtcgagttttcgcgcaagtgacagcgttagccgtccaattgaccgtttctatcgtataaacacgctgtaccccgcgcgctgggccgatataatgcggccctttgccgtcgcttcgtctgttgacgtttcgaacaggcctttggccgcagcctccgtggaagaacctaatgaaaagcgcagaaatccgtgaagccttccttcgcttcttcgaagagcaaggccacacccgagtagcctccagctctttgattccgggcaacgacccaaccctgctgttcactaacgcggggatgaaccagttcaaggactgcttcctgggccaggaaaaacgtgcgtacacccgtgcgaccagcagccagaaatgcgtgcgtgccggtggcaagaacagcgacctggaaaacgtcggttataccgctcgtcaccacacgttcttcgaaatgctcggtaacttcagcttcggtgactatttcaagaaggacgcgattacctacgcgtggaccttcctgaccggcgttctgcaactgccgaaggaaaaactctgggtcaccgtctacgcctccgacgacgaagcgtatgacatctggaccaaagaaatcggtgtgccggtcgagcgcatgatccgcatcggcgacaacaaaggcgcgccgtacgcctccgacaacttctggaccatgggcgataccggcccgtgcggcccgtgcaccgagattttctacgatcacggcgaccacatctggggcggcccaccgggctcgccggaagaagacggcgaccgttacatcgagatctggaacaacgtgttcatgcagttcaaccgcaccgccgacggcgtgttgcatccgttgccagcgccgtcggtcgacaccggcatgggtctggagcggatcagtgcggtgatgcagcacgtcaattccaactatgacattgacctgttcaagaacctgctgaaagcttcggctgaggcaatcggttgcgaaaacggcgaccagtcgtcgctcaaggttgtttccgaccacatccgttcgtgcggtttcctgatcgctgacggcgtgctgccgtccaacgaaggtcgcggttacgtgctgcgccggatcatccgtcgcgcctgccgtcacggtaacaagctcggcgccaccggcagcttcttctacaagatcgtcgctgcgctggttgccgagatgggcgaagccttcccggaactgaagaagcagcagagcaacatcgaacgcgtgctcaaggccgaagaagagcagttctccaagaccctggagcacggcctgaagattctcgagcaggatctgctggaactcaaaggcactgtggtgccgggcgacgtagtgttcaaactctacgacacctacggtttcccgatggacctgaccgccgacatcgcccgcgagcgcagcctgactgtcgatgaagccggtttcgagcgtgagatggaagcccagcgagttcgcgcgcgttcggccagctcgttcggtctggactacaacaccttggtcaaggttgatgtggccaccgagttcaccggttacaccgacaccagcggttctgcaaaaatcgtcgctatctataaagatggccagtcggtcgatgtcttgaatgaaggcgaagaggcggtgatcgtgctgaaccagacgccgttctacgcggaatccggcggccagatcggcgactgcggttatctgcaggccggcagcagccgtttcgacgtgcgtgacaccaccaagaccggcggtgcgttcctgcaccacggcgttttggattcgggcagcctgaccattggtgcgccggtggaaactcacgtcgatgccgaagtgcgtcacgcgacttcgctgaaccactcggccacgcacttgctgcacgctgctctgcgccaggtactgggcgagcacgttcaacagaaaggttcgttggtggatagccagcgtctgcgcttcgacttcagccattttgaagcgatcaagcctgagcaaatcaaagcgctggaagacatcgtcaacgccgagatacgcaagaattctgccgttgaaaccgaagaaaccgacatcgaaaccgccaagaacaaaggcgcgatggcgctgttcggcgagaagtacggcgacaacgtgcgcgtgctgagcatgggcggcgatttctccgtcgagctgtgcggcggtatccacgccaaccgtaccggcgacatcggcctgctgaaaatcatcagcgaaggcggtgtggcttcgggcgtgcgtcgcatcgaagcagtcaccggtgctgcggcactggcctacttgaatgctgcagaagaacaactcaaggaagcggccagcctggtcaagggcagccgcgacaacctgatcgacaagctgtcggctgtgctcgagcgcaatcgccaactggagaagcagctcgagcagttgcaagccaaagcggcgagcgcggcgggcgacgatctgtcgtcctcggctctggacgtcaaaggcgtgaaggttttggccgcacgtctggatggtcaggacgccaaggcgctgctggcgctggtcgatcagctgaaaaacaaactcggccgcgcagtgatcctgctcggcagtgtccatgaggaaaaggtcgttctggttgcaggcgtaaccaaagacctgactggccaactcaaagccggtgatttgatgaagcaggctgctgcggcagtgggcgggaagggcggtggtcgtccggacatggcgcagggcggcggtgtcgacgccggcgcactggatggcgcactggcgctgaccgttccattcgtcgagcagggtttataagacggcccgtcgggcccgcagtctagtggcgggcccggcggctgttcgagtgattattgggcgcccttcatgggcagaggcggctttgaaatggctttgatcgtacagaaatttggaggcacctcggtcggtactgtcgagagaatcgagcaggtcgccgacaaggttaagaaattccgcgatgccggcgatgacctggtggttgtattgtctgcaatgagcggcgaaaccaaccgtctgatcgatctggccaagcaaatcagtggcgatggccaaccggttccgcgtgaactggatgtgatcgtctccaccggtgagcaggtgacaattgccctgttggccatggcgctgatcaagcgcggtgtgccggcagtgtcgtacaccggtaatcaggtgcggatcctgacggacagtgcgcacaataaagcgcgtatcttgcagattgatgaccagaagattcgtggtgatctgaaggcaggtcgcgtggtggttgtcgccggtttccagggcgtcgacgagcacggcaacattaccaccctcggtcgtggcggttccgacaccaccggcgtggcactggctgctgcgttgaaggctgacgagtgccagatctacaccgacgttgacggtgtttacaccactgacccgcgcgttgtgccggtcgctcagcgtctggacaagatcaccttcgaagagatgctggaaatggccagcctcggttccaaggtgttgcagatccgtgcggtggaattcgccggcaagtacaacgttccgctgcgcgtactgcacagcttcaaggagggtccgggcaccctcattactattgatgaagaggaaaccatggaacagccgatcatttccggcatcgctttcaaccgcgatgaagccaagctgaccatccgtggcgtgccagacaccccgggcgtggcgttcaagattctcggcccgatcagtgccgcgaacatcgaagtcgacatgatcgtgcagaacgtcgcgcacgataacaccaccgacttcaccttcaccgtgcaccgtaacgactaccaggctgcacagaccgtgctggaaaacaccgctcgcgagatcggtgcccgtgaagtggttggcgacaccaagatcgccaaggtctcgatcgtcggcgtcggcatgcgttcccacgcaggcgtggccagccgcatgttcgaatccctggcaaaagaaagcatcaacatccagatgatctcgacgtcggaaatcaaggtttccgtggtgattgaagagaagtacctggaactggctgtgcgcgccctgcacgcggctttcgaactggatgctcctgcccgtcaaggcgagtaattccgcttcttgaagggcgcggtctgaccgcgccctttattttttgaatggcgcgagccctgaactgttcttttgctcgcgctggtcaatactcaggcatgtagggctacgatcgctccggttgtaggtcgggtgccttttttttgcagactgttgtccctgaactgaattgcgtaaggagaaaggtatgctgattctgacccgtcggtgcgcagaaagcctgattatcggtgacggcgaaatcaccgtgaccgtgcttggcgttaaaggaaatcaggtgcgtatcggcgtcaatgccccgaaagaggttgccgtgcaccgtgaggaaatttacctgcgtataaagaaagagaaggacgaagaaccaagccattaatttttatcgatttttatgtttgcaaacggggaaaaggttggttaagatacgccccgtgttgcggagagctggccgagtggccgaaggcgctcccctgctaagggagtacacctcacaagggtgtcgggggttcgaatcccccgttctccgccattatttgcttagtacgtcgtaatctggctttttctgtaagttgttgaaattaatagaaaaagtggttggaatagagattagacgggctataatgcggcgcaacaaatgcactcgtagctcagctggatagagtactcggctacgaaccgagcggtcacaggttcgaatcctgtcgagtgcaccatttaagagttagttgcagcaatgtaaatgactcggcttcaaccagatgtgatctggtctaaaaacacaaatgcactcgtagctcagctggatagagtactcggctacgaaccgagcggtcacaggttcgaatcctgtcgagtgcaccatttaagagttagttgcagcaatgtaaatgactcggcttcaaccagatgtgatctggtctaaaaacacaaatgcactcgtagctcagctggatagagtactcggctacgaaccgagcggtcacaggttcgaatcctgtcgagtgcaccatttaagagttagttgcagcaatgtaaatgactcggcttcaaccagatgtgatctggtctaaaaacacaaatgcactcgtagctcagctggatagagtactcggctacgaaccgagcggtcacaggttcgaatcctgtcgagtgcaccatataccgaaaagcccgcgtttaacgcgggctttttgctgtccgggatttggctttttccttcacgcatcccctctcatcaaaatctatttgagcactacggcctcgcttgaggtcgtatcgatagctcgtcgtcgatgttcgaatattcaccttgtccggtttgcctagcgcgctttcgacgtctttctggctcatgccggcaatgatgcgtcgattgatgattgcttcgcgacgttgtctggcgttaatcagatctccgcatttgtcttgagtgtggccaacgatgcccggtcctcggcctgcggctgtcatgccggaggtttgttcatggttgtgctctggcatcacggccacaactgatccgggcgagtaggggtggacttcctgtgcggagcgccgttcgccttgtgcacagctcatcgaggtgaaggtgatgctgccatcggcggcttcgcagcgatggagggtgagggcggccccggtcggcggcaggcagagcaggctggtgagtacaaggtgggatggtttcaatggcattcgatgtcctccatgacgatctgcgctcaagggtagtcgctacattttcgagtggtggtgtgttttcttttcaggatgagtcgtcgcatgtgcagggatcaggacagtgctcaggtttgtttcgcaagcacttgtttcggccgagattttttaacgtttaaaaccgtcaggcggtgtatcattgcgcccgtcagccccgccggggcttatggaaaacttccatggacttacccagtagttactcagtaaacagtttcaccaatcatgaattgactgattgatccttccggcgtgccccgctgctgggagtggagttcgcctatgtctgaaatcgaagtaaagaaaacacaggaaagcctgcaggatcgcctggctcaagtcgtcgagctgctgcagcgtcaacgggtcgtcgaagacctgactcatcgccaggaaggcgcgcatcacgaccgggttgaaaacctggttcaccggcagaaccttgtcgagctgcaacgcaagctcgatgatctgcactccgctgacgtcgcctacatccttgaagccttgccgctggatgatcgtcttacgctctggcaattggtcaaggccgatcgcgacggcgacattcttcttgaggtatccgactccgttcgtgaaacgctgatcgccgacatggatgatcacgagctcctggctgcggccaaggacatggacgccgacgaacttgctgaccttgcttccgagctgccgcgagacgtcgtccatgaactgatggagagtctggataaccagcagcgcgagcgcgtgcgttcggctctgtcctatgacgaggagcaggttggcgcactgatggacttcgagatggtcaccatccgcgaagatgtcagtctcgaagtggtactgcgttacttgcgtcgcctcaaggagcttccgggccatactgacaaactgttcgtggtggattacgacggtgtgctcaaaggtgtgctgccgatcaagcgtctgctggtcaatgatccggacaagcaggttgccgaagtaatggcgagcgacccggtgagtttccacccggacgaagatgcttatgacgccgctcaggcgttcgaacgttatgacttgatctcggccccggtggtcgacaagaacggcaagttgattggccgtttgaccatcgacgaaatggtcgacctgattcgtgaagagagtgagagcgaagttctcaacatggccggtctgcgtgaagaggaagacatcttcgcctcggtctggaagtctttacgcaaccgttgggcatggctggcggtcaacctgatcactgcgttcgtcgcctctcgagtgatcggtctgttcgaaggctcgatcgagaaactggtagcgctcgcagcactgatgccgatcgtggccggtattggtggtaactccggtaaccagacgatcaccatgattgttcgcgccatggcgctcgaccaggtcagcaccggcaatacttcgcgcctgatgcgcaaggaactggcggtaggcctgatcaatggcctggtctggggtggtgtaattggtgtggttgcttatctgctctacggcagttggtcgttgggcgtggtaatgacagcggctatgacgctcaatttgctgctggcggcgttgatgggagtattgatcccgatgaccctggcgaaaatggggcgcgacccggccatgggggcgagtgtgatgattactgcgatgaccgacagtggcggcttcttcatcttcctcgggctggcgacgatcttcctgctctgatccgctgcatcgaaaaagcccgcctatatggcgggctttttcttgtctgtgaaaactcaaaatccgcgcaaaaaaaagccagcggttaagctggcttgacgtgttcggtgtggctcaggacgcgtctgctgccatttcggcatcgtgtgcgatcaaggataccaaagcgttctgttggcggtgagacagttggcggaatcgttgcaacagctcgcgctcatgcagcgacagctccgggctgtccaggcgcatgctcagctcttcgcccagtgcaccttcctgaataagactctgctcaaggcgcgcaatgatctcggagttcatgctgcgatgatgattgcgagccacctcggcaatgcgttcacgcattccgtctggcagacgtacgacgaacttgtcagccgtacggctggaataaattgcctgtttcaatgggcgcatatatttaaccggttagttcaggggagcggttctcgggattggccgcaggatgtgtggtaggacaagcatccgcgccaaatggttcaacctgaattgttaagaggccggcatcatgcctcaaaattgccagatcattggcgtcaattctgtgacaaatattgagccgggtaaaggcgtaatgccagcaccaatcatcagaaatgcggactggtttgaaaactttgccttggtctgcatcgctgtatgcctcctggtggccatcagttgatgtctgaagacgtgaaggcgtgcatgctatatggctttctatccttgttccctgtctgtgaaggatagtggcaaattgccgatttactagtggctacgttgttgtggaggcgttttcaggatgggtggcaagcttatttatctgatgggtccatccggatcagggaaagacagcctgattgaagccgcgcgcgaacggctgcgagcaatggggtgcgaggtaatgcggcgagtcattacgcgatcagctgaatcggtgggtgaagatgcggttggtgtaacgccggaggagttcgagcgacgtgcgcacgaggggggcttttccctggcatggcacgcgaacggtcttgcatatgggatcccggccgaaatggatcggattttggcagcggggcaccatgtgttggttaacggctcgcgcgctaatctgcggcaagcgatgagccgttaccctgagctggtgccggtactgcttacggtaagtgacgaggttttacgtaagcggctgctaaggcgtgggagagagtcgcttgagcaggttgaggcccgacttgcccgtaactctttatttaaagaccgcaggtcaagtgacgggccggtacatatgatcgataactcaggtgagctggcgggggcggtgaaccagttgcttgaccttatccggctcagcgcaggactggatcaaacttgatcttgcgtccggcaaccaacgccaggacaaacagcatcgaaaatactccgcagacaatcaggggcagggtgactgtggtttcctcgaaaagcgaaaaatgcatagcgccactcaaaaaggcgaggatcagaaatcctgcggctgatttggacatgctgtactcctgaagataattcaaaaaaccagacgttctgtaggttggattggcaaagcctgttcggaggcgctgacgatccttgggacaaggttgctgttatcgctcagcactgccagttggggctgcttctgcacttgcaggtaatgcggcatgcgctgggctatcgattccggggcggtgctagcggggataaagtgaaaactcagcaaaaccgctagtgctgtcgcatttgcaagcaagagggtggtgttcatggggccgcgctccgattgttcttctatagaacaggcaaagcagtcgtcatgccaatagtctaatcgctggcaagtcctttaaaaacaaggatatgagagacttgatagaattgcttgggttgcaatctgcaatgatggctttttggcgggagtgcaaaatgcacggtaaatcttcccgcgacataccagtgcgcatgcctacacttaatatggctacggatgacatgacaaaccggaacttggccgttaacatgcacgccgtccgtcgcgctgcttctgcttgcgacaatcgcgtgtctcagtagctcaattggatagagcatccccctcctaaggggaaggttggcagttcgaacctgccctgggacaccatctattgtttgaatccccttctattagtagtgcccgccagtattttggtgctcttctcgtgttcttgttgcttgacgttcttgggtgcggatgcggtgatggtgggttccagtgtctgccggatgctcctcttggtttcggctcgatttcaggcgttctgtctatatgacggcatgacggcagtttttccggcgtttcgatagaaaattgaaattaacggttgacggcagatttgagatgtctataattcgccccacttccggcgcagtcgaaacggaaaactccttgagattcaatgagttatgtaggtttcggcagcaggttacttcagttcatcgaagccaaaaggaagttgaaaaagaggtgttgacagcagcgtgtaacgctgtagaattcgcctcccgctgcagagagatctgaagcgcaagtggttgaagttgttgaagagttcttcgaaaacttctgaaaataatcacttgacagcaaatgaggctgctgtagaatgcgcgcctcggggatcgaaccgctgacctcctgcatgccatgcaggcgctctcccagctgagctatagcccctcatcgttgatgtcatcgctgaggacggggcgaatcttaagggcgtatcgaaagcctgtcaaacttatttttgaaatttttcaaagtttttcgtcggcataacaatcacttaccgccctcctcccgaaaatccgggacttgggataaagcatgcccctgcaggagctgccgaaggctgcgatcttttgacgttgccgtttaaagatcaagatcaaaagatcgcagccttcggcagctcctacaggggggttaagctatcaggcgatagcgcccagcagcttttcccactctttgttttctttcttcgacacgccgcccagcaggtcgatcgcctgacgcagacggaagcgggtcagatccgggccaatgatttccatggcatcgagcaccgataccgaactcgcctgcccggtgatcgcagcaaacatcagcggcatcgcatcgcgcagcttcaactcaagggattcgaccaccgcctgaatcgttgcagtgatgttgtccttctcccactgacgcaggctttccagcttccataggatcaactgcatcaactgccgaacctgatcgccggagagtttcttcgattcaaacagcttggcatccgggttaacgccaccagcgaagaagaacccgcccagcggtgcaacctggctgaaggtttcaacgcgaccctgaaccagtggcgcgatcttcatcatgtattccggattcagcgcccaagtctgcagacggctggcgaactcgtccaccggcagatcacgcagccattggccgtttagccacgacagcttctcgatgtcgaagatcggcccgccgagggaaacacgcttgaggtcgaaattgtcgaccatttcctgcagcgagaacttctcgcgctcgtccggcatcgaccagcccatgcgaccgaggtagttgagcatcgcttccggcatgaagcccatgcgctcgtagaacgtcaccgaggtcgggttcttgcgcttggacagcttgctcttgtccgggttacgcagcagcggcatgtagcacagctctggttgctcccagccgaaatattcgtagagcagaatcagtttcggcgccgatggcagccactcttcaccacgcaggacgtgggtgatgcccatcaggtgatcgtcgacgacgttggcgaggaagtacgtcggcaggccgtcggtcttcatcaacacttgcatgtccatgcgatcccacgggatctcgacatcaccacgcagcatgtccggcaccacgcaaacgccttcgctcgggactttcatgcggatcacgtggggttcgccggcagccagacgagccgcgacttcctctttcgacagcagcagcgcgcggccgtcgtagcgtggagtttcgccgcgggccatttgctcggcgcgcatctgatcgagctcttcagcggtgcagaagcaggggaacgcgtggcccatgtcgaccagttgctggcagtacttctggtagatgtcgccgcgctcgctctgccggtaaggaccgtgcgggccgccaacgtccgggccttcgctccagtcgatacccagccagcgcagagcgtcgaagatctgctgttcggactcgcgggtcgaacgcaactggtcggtgtcttcgatccgcaggatgaactcaccgccgtgctgcttggcaaagcagtaattgaacaatgcgatgtaagcggtacctacgtgggggtccccggtaggcgatggcgcgatgcgagtgcggacggtggtcatggcatgtctcgaaaagaatgaaaagcaaaacaatcaagcggcgaatggtaacaggcgacacccgccccgctccagcgggcagggcatttaagccaagtttgcgtctgtaaggaccgtaagccgtgatgaatggcggaatatcagcagatggcatttaccgtttatcggctgtatgccagattcgccggctgataactttccttacaattcctcgactacagtttgcccatgcctgctcaactcaagcgtcgcctgttgattttcctgctgctcgtcctgctgattgccgggggcttcttcgcccattggtttttcaagggacgcttttatgaaagcaccgacaacgcctatgtccagggcgaaatcacccgtgtgtcgagccaactgagcgcgcgcatcgatgaagtgctggtgcaggacaatcagcacgtcgaaaaaggccagttgctggtgcgcctcgaaccgaatgatttccgcctcgctattgatcgtgccaacgccgccctcgccacccgcgaagccgaacgcctgcaagcgcaaagcaaactgacccagcaatcgagcctgatcgccgccagcgacgcgcaagtggcaaccacacaggcgacgcttggccgttcgcagatggacttgtcgcgtgccgaaaccctgcgcaaacccggttatgtttccgaagaacgggtgaccaccctctccgccgacacacacattgctcgctcgcaagtggccaaggcgcaggccgatgcacagggccagcgccagcaggtcaacgccttgaacgcggaaatcaaacgcctcgacgcgcagatcgccaacgcccgcgccgatctcgcgcaagccgaactcaacctgacccggagcgaaatccacgcgccaatcagcggcctcgtcggccagcgcgccgcccgtaacggccaggtggtgcaggccggcgcttatctgctgtcgatcgttccggacgaagacatctgggtgcaggccaacttcaaggaaacccagatcggccatatgcaacccggccagaaagccgagctgaccttcgatgcgtatggcgacacgccgatcgaagcgcgggtcgacagtctgttcgccgcgtccggcgcgcagttcagcctgctgcccccggacaacgccaccggcaacttcaccaaagtcgtgcaacggattccggtgaaactgaccttcaaggccgataacgcgctacacggcaagatccgcccgggcatgtccgtcaccgccaccgtgaatatcaaagacgccccagaagatggccggtgattcattgatccgaccggtcggcgaaccgacccggcgcgactggattgcagtgatgagcgtaatgctcggcgcctttatggcggtgctggacatccagatcaccaactcgtcgctgaaagatattcagggcgcgctgtcggcgaccctggaagaaggttcgtggatttccacctcctatctggtcgcggaaatcatcatgattccgctgaccgcgtggctggtgcagctgctctcggcgcgacgtctggcggtgtgggtgtcgctggggtttctggtgtcctcgctgctgtgctcaatggcctggagcctggagagcatgatcgtttttcgcgccatgcagggtttcaccggtggcgcgctgatcccgctggcgttcaccctgacgctgatcaaactccccgaacaccaccgtgccaaaggcatggcgatgttcgccatgaccgccacgttcgcgccgtcgatcggcccgacgctgggcggctggctcacggaaaactggggctgggaatacatcttctacatcaacatcccgccgggcctgatcatgatcgccggcctgatgtacggactggagaagaaagaagcgcactgggaattgctgaaaagcactgactacacgggcatcctcacgctgggcatcggcctcggttgcttgcaggtttttctcgaagaaggccatcgcaaggactggctggaatcgagcctgatcgtgacgctgggcagcattgcgctggtgagcttgatcacttttgtgatcgtgcagatctccaaaccgaatccgctgatcaaccttggcattctgcgcaatcgcaattttgggttgtcgagtatttccagcctgggcatgggcgtcgggttgtacggttcgatctatttgttgccgctgtatctggcgcagatccagaactacaacgccctgcagatcggcgaagtgatcatgtggatgggcgtgccgcagctgtttctgattccgctggtgccgaagctgatgaagattgtctcgccgaaatggctgtgcacgcttggcttcgggttgttcggcttggcgagtttttcttccggagtgctcaacccggactttgccggaccgcaattcaatcagatccagatcattcgggcgctggggcagccattgatcatggtgacgatttcgctgatcgccaccgcgtacatcctgccgcaggacgcggggtcggcgtcgagtctgttcaatatcctgcgcaaccttggcggtgcgattggcattgccttgctggcgacattgctggatgcacgcaccaagacttacttcgattatttgcgcgaggcggtggtgccgaccaatccacaggtggcggagcgattggcgtcgatgaccgatcggtttggcaatgacacggcagcgttgggcaagctgagtgagatcgtccatcaacaggcggcgatcatggcttacaacgatgcgtttcattttgtcgggattgcgttggggatcagtatgttggcgattttgttgaccaagaaattgccagagggactgaaggctggggagtctcattaagaccgcgtcgcctcaatcgcgagcaggctcactcctacaggtcttgtgagcgccacagaaccctgtaggagtgagcctgctcgcgatgaggcccgaccagacaacacaaatcaaacagccaaaagccgctcacgcagtttggcaatctcatcacgcatctgcgccgccgcttcaaactccagatcccgcgccaactggtacatcttctcttccagcgcgcgaatgcgtttggtgatctcgctcggcgagcgcaattcggcttcgtacttggcgctctcttcggcagccttggccatgcctttgcgcttcttgctgcgcgaacccggcacggtggcgccttccatgatatcggcgacgtccttgatcacaccgcgcggggtgatgccgttttccaggttgaaggcaatctgcttgtcgcgacgacgctcggtctcgccaatcgcccgctccatcgaaccggtcatgcgatcggcgtaaagaatcgcccgaccattgaggttgcgcgccgcacggccgatggtctggatcagcgagcgctcggaacgcaggaagccttccttgtcggcgtcgagaatcgccaccagcgacacttccggcatgtccaggccttcacgcagcaagttgatcccgaccagcacgtcaaaggtgccaaggcgcaggtcgcgaataatctcgacgcgctcgaccgtatcgatgtccgagtgcagataacgcacgcgcacgccgtgatcggcgaggtaatcggtgaggtcttcggccatgcgtttggtcagcgtggtgaccagcacccgctcttcgaccgccacgcgtttgctgatttccgagagcagatcgtcgacctgcgtcaacgccggacgcacttcaacctgcgggtcgaccagaccggtcggccgcaccacttgctcgaccacgcgcccggcgtgttcggcttcgtagttgcccggcgtcgccgagacgaaaatggtctgcgggctgaccccttcccactcgtcgaaacgcattggccggttatccagcgcagaaggcaaacggaagccgtattcgaccaaggtttctttgcgcgaacggtcacccttatacatcgcgccgacctgcggcacgctgacgtgggattcgtcgatcaccagcaaggcatcggccggcaggtaatcgtagagcgtcggcggcgccgcaccggccggacgtccggacaggtagcgcgagtagttttcgataccgttgcagtagcccagttcgaggatcatttccaggtcgaaacgggtgcgctgctcaaggcgctgcgcttccaccaatttgttgttgctgcgcaggtattccagacgctcctgcaattcgactttgatgtgttcgatggcgtcgagcagggtttcccgtggcgtcacatagtgactcttcggatagaacgtgaaacgcggcatcttgcggatgacttcgccggtcagcggatcgaatgcggaaatgctttcgacctcgtcatcgaacagctcgatgcggatcgcttccagatcggattctgccgggtaaatgtcgatcacatcgccgcgcacgcggaaggtcgcgcgggcaaaatccatgtcgttgcgggtgtattgcaggtcggccagacggcgcagcagtgcgcgctgatcgagtttgtcgccgcgatcgacgtgcagcaccatcttcaaataggtttccgggctaccgagaccgtagatgcacgacaccgtggtgacaatgatcgcgtccttgcgctccagcaacgctttggtcgcggacagacgcatctgctcgatgtggtcgttgatcgacgcatccttctcgatgaaggtgtcggaggacggcacgtaggcttcgggctggtagtagtcgtagtaggaaacgaaatattcaacggcgttgttggggaaaaacgccttgaactcgccatacaactgcgcagccagggttttgttcggcgccagcaccagcgtcgggcgctgaatctgcgagatgacattggcgatgctgaaggtcttgcccgagccggtcacaccgagcagcgtctggtgcgccagcccggcttcgatgccctccaccaattggcggatggcttccggctgatcgccggcgggctcaaagcgggtgacgagctggaattcggacatatacacctctggaatcgcggcgttccgcgcaaagcggagcactacggggacaaccgcaaacgaccggtgtcgcgcaagaaaaaacctggattgtgctcaatgtggtggcgattgcccgctctttcaaggcaaacgtcctacatccgctaaagactctgacacgggcagtcgactgacggtcaagaaataatcggaaaaacttaccctaaaagccgaatcgcctgtcgccattgttccgtaatggcctctatactagctccccgtttgtgcaccgctctagtgcatccggctggagcgcgacacgtccctccattctccattcagagccgccgcaataatgagcctgttctccgctgtcgaaatggcaccccgcgatccaatcctgggcctcaacgaagcattcaacgccgatacccggaccaccaaggtcaacctgggcgtgggtgtttactgcaacgaagaggggcgaattccactgctgcgcgccgtgatcgaagccgagacgattcgcgtcgctcaacacgcttcgcgcggttacctgccgatcgatggcatcgctgcctacgaccaggccgtgcaaaagctgctgttcggcaacgactcgccgctgatcagcgccggtcgcgtcatcaccactcaggccgtcggcgggaccggcgcactgaaaatcggtgccgacttcctcaagcaattgctgccgaacgccgttgtggcgatcagcgacccgagctgggaaaaccaccgtgcgctgttcgaaaccgccggtttcccggtgcagaactatcgctactacgacgctgccacccacgacgtcaaccgtgccggcatgctcgacgaccttaacgccctgccgaacggctcgatcgttatcctccacgcctgctgccacaacccgactggcgtcgacctgaccccggcggactggaacaacgtcctggaagtggtcaaagccaaaggtcacgtgccgttcctcgacatggcttaccagggtttcggtgacggtatcgacgaagacgccgcagccgtgcgtctgttcgctgagtccggtctgacgttcttcgtttcgagctcgttctccaagtcgttctcgctgtacggcgagcgcgttggcgccctgtcgatcatcagcgaatcgaaagaagaaagcgcgcgcgtgctgtcgcaagtcaaacgcgtgatccgcaccaactactccaacccgccaacccacggtgcaagcatcgttgctgcggtgttgaacagcccggaactgcgcgcgcagtgggaagccgagctggccgaaatgcgtctgcgcattcgcggcatgcgcgagcagatggttgccctgctggcggaaaaagcgccgggccgcgactttagcttcgtcggtcgtcagcgcggcatgttctcctactcgggcctgaccactgaacaagtgcatcgcctgcgtaacgagttcggcatctacgcactggacaccggccgcatctgcgtggcggcgctgaaccagagcaacatcaaggctgtgacagatgcgatcgttcaggtcatctgataacgctgcgtgatgaaaaacgggaagccttggggcttcccgtttttatttgtccgaaggaatgccacattccctctaaactgcacacaaatcaaaactgtaggagcgagcctgctcgcgatagcgtcttgtcgcccgaagcatcactgtctgacgcaccgctatcgcgagcaggctcactcctacagggatttgagtacaccttggaattctgtgagaagccaaatgaaaaacgacaacctgcgcgccgaccgtgacgatctggatgatttcatcccgcgcgcctcggccaagcgcgaaaaaagcctggtgctgcaagtcgcggccggggtgtttcttggcggcctggccttgtggctggtgcaactcgcagctactgcggcctacgccaagctgatgctgggcacaattacctttggcagttaagccagttcagtcgcacgctgagtcgcggcatcgtcataggcgacgtacagcgattcggcgatctggcttttgatcgctttggtgctttccagaccgaggacaaaaccttcggccttgcccccggcacgattcagttcttcagcggtgctggcctgagtaatcgcgtcgaagagtttttcggcatgtggaccgacacccttgggcaggctgatttgcgcgatgctcatgcgaacacctcgctgttgcgggacaaatggttcatgacgcggacctttttcggcgaatggccggcagcgcgtgtgaccacttccgggcggtcatggtagacctctactacggttctggtaaccgccaatcgctgacaaaccaccgtccgtcccgggaattcactcgtttttgcaaccggcgcttgacttctctttttgaatcagtaacatacgcaccaattccgcaatagctcagttggtagagcaaatgactgttaatcattgggtccctggttcgagtccaggttgtggagccaaatagcaaagcccctgaatcgaaagattcaggggcttttttgtgggcgctcgaaaagatcaaaagatcgcagccttcggcagctcctacacaggtctcgtattccgcccattttgcggatgaacgctgaacctgtaggagctgccgaaggctgcgatcttttgatcttcaaacaaaaagggccgatctgattaacagatcggcccttttccattcagctacagcggtcagacatgctcactgcttttcacctgcaccttcggcgcgccatgcccatggtcgtgatcatccggctcgatcactggcacttccttgccatcgcagtcatgcagtttgccgtcgctgaagtagtcgccttcgcgcagcgcatccagatcgcgataacgcaaggtgcgctcttccgccgccgcaaacaccgactgctgatccgagttaccggtggtgaagtggttgaacgccaggttgagcaggatcgccatgatcgccgacgagctgatgcccgagtggaaaatggtcgcgaaccagcttgggaagtgatcgtagaagttcggcgcagcaatcgggatcatgccgaaaccgatcgaggtggcaacgatgatcaggttgacgttgttgcgataatcaaccttcgacagcgtacgaatgccactcgccgccaccgtgccgaacagcacgatacccgcgccgccgagaactgacgtcggcactgcggcaatgacccggcccatgaacggcagcaggccaagaaccaccaggaacacaccgccagtggcgaccacgaaacggctcttgatcccggtcaccgccaccagcccgacgttctgagcgaaggcactttgggtgaacgaaccgaagatcggcgcaaacatgctcgacagcatgtccgcccgcaggccgttacccagacgtttggaatcgactttggtgccgatgatttcaccgaccgcgagaatgtcagcggacgtttccaccaaggtcaccatgaccacgatgcacatcgacaggattgcggcgaagtggaaggtcggcataccgaagtggaatggtgtcgggaagccgaacatcggcccggtggtgacgctggagaagtccgccataccgaggaacaccgccagcaccgtaccgatcaccatggccaacaggatcgacagacgcgagatggtcgagctgccgaccttgctcagcagcagcaccagcaccagcgtgaccgccgccagtccgatgttctgcatactgccgaagtccggcgcgtggctgttgccgcccatggcccagcgtgcagccaccggcatcagcgtcaggccgatggtggtgatgacgataccggtaaccaatggcgggaagaacttggtaatgcgcgagaacaccggcgtgatcagcagcccgatcaaggacgcggcaatcaccgcgcccagcaccgactgaaagccgccctccccgccgctgctgacgatcgcgaccatggtcgccacgccagagaacgatacgccctgaaccagcggcaactgacagccaaaaaacggcaggcccagggtttgcagcagcgtcgccagcccccccgcaaacaatgaagcagcaatcagcaaaccaatgtccgccggcgacaggccggccgcctggccgatgatcagtggcaccgcaacgataccgccgtacatggtcagaacatgttgcaggccgtaagccatattcgcgccgaccccgagattttcgtcctcgggccgttggtgtgaaacatggggcgttttcatggtggggggttccctggtttttgttatgcgcacactgtattcaatactcgtgacaaatgtccatagagttgtatacaacttatcagtcacataatggataggtagccacccatgcttctatcccgccgcttgcatcccccacaaacccggcaacacatccctaccggcgtctgcgccaacccccactaggctgaactgttcatggcgaccgacggtacggtcgcgtcgttttttatacatataaagtatgcataatgaagtcattggacattcagtacgacaaaagcaagaacgcggccaacaaactcaagcacaaaggcgtcagcctcgccgagaccgaaccggtctttcacgacgaacgagcactgacgatcgaggacaacgaccatgacgaacagcgctggatcactattggcctcaacggcaaagggcgcttgttggtcgttgcgtacagttaccgagacgcgaatgtcgtacgaatcatttctgcccgtgtcgccacaccgagcgaacgtagcgcatattttcaggaggcttgaccgatgaaagatgaatatgacttctcccagggcaaacgcggcgcactggcggccgccaagggcaaaacccgtatcaccatcatgctcgacgatgctgtcatcgaggcggcgcgcaacgtcgcggaaaacgagggtttcggttatcagacggtgatcaacaacacgctgcgccaggcgttgctcgagggtgccacacagccggccgatgatccggccctttccgggcagttcaaacagggcattaccgccgccgacctcaagagtcttgagaaaaagctgtcggcagccgtcggggaaatccgtcgcgtactggagccggatgcaaaaccctgattgtcagacaggcacgagcattcgcgccagcgactggcgtacatgcggctgatccggcacgcgcagaccgaacgcctgttgcagcacgtcgatgagttcatcgacgtcggatatttcgcgccgctcactgtcagcgcccatgcgatgcaggacgaaactgccgttgttcaaggttttacgccagccgtcgccagtacgcgcagccatcaggcgcgtggcgaaaggagattgcgggtgggtcgagacgtaccagttgccgatggtgtaatcaatgtcttcctggcgctgcagatcgaacaggtacatcgaccgccactcgccggcgaccttggcgcgcagcatgtagccatcggcctgtttttcgatgcgataaggttcgtgaggggtgacctgctcagcttcggaatccagcaacagcggtgcggtcggcaccatgccgccaaacccgacgtcggtgatgtaacgcacatcatcgatggtcaccagactcaatcggtgggtgcgcgcagtccaggtgccttcaggctggttcatgaccactcgaccactgatcgcacgagcatcgaaacccaattcgagcaacagggcataaaacaggtgattgagttcgtagcagtaaccgccacgcccctgatgcaggaccttctgttcaatggacggcaaatcgatcagtaccggcgcgccagtaatggtcgagaggttttcgaaggtaagggcgccggtatgacgccattgcaattcacgcagcgtcgccagtgtcggcgccggcggcgcagcgaaacccaggcgttgcagatacagtttcacatcgttcaggcgtggctcactcattgctcgatccttatgcatggggccgcaggtcactgcgttgatggtcgccatgtatacgggatcgggcagctgtttcgataattgatttcgccaatcgtccgctagcgccttttgcgcgaaccgatacgaatccacgtcggcgcatggtcgctggcatgcggctcgttgcgtacccaggcgtctaccccggcctcatgcaaatacggactgagcgccgggttgagcagcaggtgatcaatgcgcaaaccggagttggtttgccagtgttggcggaagtaatcccagaatgtataaagccgatcctcgggatacagatggcgtagcgaatcggtccagccctgatccagcaaccgctgataacacgcgcggctctcgggttgcagcaacgcatccttgagccaggaacgggtgttgtagatgtccatgtcggtgggtacaacattgtagtcaccggccagcaccaccggatgatcgctgccttgcaggtctttcgcgtagctgatcagtcgttcgaaccaggccagtttgtaatcgaatttcggtcccggttgcggattgccattgggcaaataaaggcagccaaccaataccccgtgcaccgccgcttccaggtaccggctgtgcttgtcatcagggtcgccgggcagcccgcgccgactctccagcggttgcgcatcgcgggcgagaatcgccaccccgttccacgccgcctgcccttgccagatcgcgccgtaaccggccgcttccagttcagcggcgggaaacgcactgtcgagcgacttgagctcttgcagacaagcaatgtcgggctgctcgcgctttagccactccagcaggttcggcaatcgagcgcgcaggccgttgacgttgtaagtggcgatccgcagatttttcattggctgaggctcctgcccatggtctgtagaaaatctgactccgcgtcactcgcgccggttgcatcggatcggcacgttgcggcgtaataggccatccacccgcaccgccgagaaccgaatccatgcaaactacgctgcaaggccagcgcatcgttctgcgcccgcttcagtatgccgacgccgacgccctgctccacgccgccgctgacggcgagttgtggaacctcaccgtcaccgtcgtgccgtcgccgggcaccgtcgacagctacctgaaaaaagccctggatggccgcgacgccggcacggtcatgccgtttgtcattgtcttgaaggacagcggcgaagtcatcggctcaacgcggttctggaagatcgacccgctcaatcgcaagctggaaatcggcagcagctggatcgccgaacgctggcagaaatccttcgtcaataccgaagccaaatacctgatgctgcgtcacgccttcgaagtgctcgactgcgtgcgcgtgcagttcaccaccgatgaaaacaatcagaaatcacgtcaggcgatcctgcgcttgggcgcacaacaggaaggtatcgtccgccatgaacggatcatgccggatggacgcaagcgcaactctgtaaggttcagcatcatcgatgacgagtggttacaggttcgccagcgccttgaacagaagttggcggcgtacgactgaggcgaccgctcgtcacccgacaggcaccaagtgcgacgcgcctcagaccaatgtcaggtaaccggccctattctggagacctaccatgactacccgcacactgacgtcactcgtgcttgccggcctgctggcaagcacttccgccgcagtcttcgccgccaacgatggcgcggatgccaccggcaccaaatccggtgccaccagcggctcgaacatgccacccaacagcacacctggcgccccttcaagcagcactggcaatggcaatgacggggccaggactggcaccggcaccggcaccaacggtggcgccagcggctcgggttcaggtgccgggggtggcaccggtgcagcgggcggcggcaccggcggcgcggggggtggtactggcagctgaacgaacaagagcaggccatggtgagcgccatggcttgtctgattgcgcgccgatcaacgatccgagcgcatcagctccccgatcacggtttccatcgacaacacggcggcgcgatttcgtccggcatttttcgcttggtacagtgcagcatcggcgcgctggataaacacctctgggctgtcattgcccagagggataaaggagtagcaaccgaggctcaccgtgagataccccgaaggcgagccgctgtgagtgatgcgtttgtccatcacactacgccggatctgcccggcaatggccagtgcgccattgatgtcggtgtccggtagcaacacggcaaactcctcaccgccataacgtacggccagatcagccttgcgctgacagcaactcttcaccacctgcgccacctgggtcaggcaatgatcccctgcgacgtggccataggcgtcgttgtagcgcttgaaaaaatcaatatcgagcatgatcagactgaccgggctggactgccgtgcgccgcgggcaaattcgatgtccagcgaacgctcgaacagccgccggttggccaacccggtgaggctgtcatgggtggcaatctgttccagcgtacgttgtgccttgcgcaggtttttctcgatccgttcgccgtcacgcacctggtggatgaacacccagccgaacagaccgacccccagaatcaccaacgcgatgatcacactggactggaacgcgcgcgcgtgccaacccttgagaatcgtgtcgcgcgacgtcgccgccgccaccaccaacggatacgacgccagttgccggtaaccatataaacgcacgacgccgtcgaccaccgagttgatcatcgccgtaccggccgaggcctcgggcaacaacgactgataaatcctgccctgcgccagcgaagaaccgatcaaaccctcatcgaaaggtcgacgcgccaacagtgtgccgtcagtcagaccgagaaacatgatgccgttgttatccaggctgaagctttcgaagaaccggtcgaagtaggacatcttgatcccggccagcaacacgccctggaagttgccggcgcggtcgttgatgcgtttcgaaatcgggatgatccattcgccgttctcgcgactgcgaatcgccgggccgatgtgcgccagcgtcgaggcattctgttgatgaaatctgaagtactcgcgatccgcaacaccagcgtcgcgcggcagatcggtaaacgaggtgatcgcccactgcccctcgcgatcgaacaggaatatgccatgcaactgatccagttgctgcacgcgccgggcaaaggttttctgcaaacgcgccttctggccggaaccgtaaccatcgtcctcgatccagtcggccaggctggtcagcaccagatcagcggccagaaaggtgtcctcggcctgttgcgccatggcccgggtcagattgcccgaaaccatttcagccatttccagatcctgccggcgcgactgctcgagctgcaggtacagcaaaccgaacaggcacagacataccgcaacgataaacagcgccgccgctttgcgcagcggcagacgcttaagcgtgccggaggcttgttgcggatcgtgaatggggataggcaaaaacgtgtcctgggcaggtacgacaggggcaaacgcccgaaacccttgtgttgatgagcgtagcccaccgggacataccgggcaaacgccctgatcccgcccagtagtatcggcgcgcagcgagtttggatgatcgctgttcgccgatttattttcgattgttctttacggttagtccgttgtgaagtgccaggcggcgcagtgcaccgtgcagtgaagcgctggctagcgacctcgatctggaaatcctgcgcatcggcatgccggaagacttcgatgcccgccgcatggcgctgatccttgccggcttcacccgcaaccacccgcacgcgtctggaaaccatcagcggcatgagcctgagctgcgccagcggctcgatgctggcgacatcgacatcgccctgatcaaacgcgaaccggacagcggcccggcatgggcaacctggccggaacggctggtatgggtcaaaggcgtggatttcgattcgtccagtggcgtgctgcagctgacgctgtttcctcaaggctgcctgtatcggcagcgggcgattcgtgagctccatgttgtgcaagggccgtggcgggtggtgttggtcagccgtgagggggtcttgaatgggttaaagcacggcttggtggggtttttgcgtggggagttgggtgtggatgcaaatgggcaagtctgatggcgcgtctggcttcactgccaactttggagaaattgcagcctggttattattcgatatagctgttggaaatagtggactcatgagtaaaaaaactaaatgaacccgcgaacctgttacttcttacagtagaggcttacgaaaaatacgccgaccctaggacgctcaagacccgctcagaattcgcttaaagcacagcaatctctgacacgggtcagaatcggtttcgagggaataaccatgcaaacgacaagacttgcctactgcgcactcgccctgctatttacactcgatagcccacaaattcttgcggcacacgaccaggaatgccaaggggcttgggcccagtcaaaagcctatagaagctgcaccggcgatgactggaccactcaaagtcctgaaggtgtttgcaatttgaaacagacctgccaaaagattaaaaaaaccgacccactaacaggtaacagcccggcgagttccacgtatcagaaacagtctgtcagctttccactgaacgatgtatcgaagttgaataactgcgacggcattctaaaaatcacgccctgctaatgataagaacgaggtgagcaccaatagcccaccgcgttgaaaaaccatatcgtcttgagttattaatcgatcagcgcgacggcggcacccgaatatctcccgcccggcactgggttttcacgcccttgccacacgcgccgaactgcagatccttatccatgcacacgcgcacttccgacagttccgggccgctgcaaatcaccgcgatcccatcggccggaattcccgggttggccttgcggaacagatcggcgatttcctgggcttcgaagtaataggaactgctgaacggttgcagttcgtccgggattttcaccgccgccacggctttgtccgcttcatccagatagcccatcgcgccgagaccgctgcacgtgccgtgtttggaccattcgtggtcgagcagttttttggtcgggaacagcgtcaggccctggctggtttgcgccgcattcaacgtcgtcagcggtgggcaggattccggccagccacccttggcgtattgcggccacaaaccgtgaagcacaaagccgtagcctttgcccgtgcactgcgagtcatctttgtgcgtcaaacaaaaggtcggcgaccaggacaacgccagcaggtagtagtcgaacacccccgccaccgattccgtctgcgccttgctcggctgtgattgccgcgccgaactcaagccgatgctaccggccgtcagcgcgatcaccgcgaaaattgtaaacagctttttcatctacccgctccttgggacgcctgcgtccgtggttttcgatcctggccagactgggccagcgctgatttcgccatgtttgtgttgcaagcgcatgacgcaaggcaaggctgtacgccgttgaaaggtctacgattaacaggcagacatcaaaccaagggatccgaaatgagtaaagcagacgaactcgccgccaaactcaagcaaacccggcacacccacgcggatgccgcgctggagatcgattgctggccggcgcaggtgtacgacttgtaccaccgcattgaagcctggttacagccagtcaccgaggtcgggttgaagattcggcgcaatcctacccacgtttgcgaaacgtctcccgatggtgaatcccacgattacgccatcgaccaactggtgatcgaagccaatcatcaaagcctgacattcgatcccattgcgcggtttaccgaggatggcgccgggcgagtgcagatcatcccgtcagccacggacacctacctgctgcgtaccgtggatgaacacggtgaaagccattggtgggtgcagtcgattgaaacaggccaacagttggacgccatcgccctgaccgaaaacaatctgttgctggcggtgcaggaaggcctcggcctgtagagcaaatgatcaaactgtcaaaactgtaatccccacctcagccaactgaaagctggcgctggttagcctctccgtcatgagtcaaacggggatttccagcgcatgccttccaacccatcacgacgcaccttcgtcaaaggtctcgccgccggtagcttgctcggcggcctcggtctttggcgcacgccggtctgggcgctcgacgcgccaggtcaggtgaatgaactgagcggcagcgacttcgaactgttcatcggcgaaaccccggtcaacttcaccggccgccctcgcacggcgatgaccatcaacggcagcctgcccggcccattgctgcgctggcgcgaaggcgacaccgtgacgctgcgggtgcgcaaccggctcagcgccagcacctcgatccactggcacggcattctgctgccggcgaacatggacggcgtgccgggcttgagctttcacggcatcgaaccgggcggcgtgtacgtctaccaattcaagcttcggcagaacggcacctactggtatcacagccattccggcttgcaggaacaggccggcgtctacggcccgctggtgatcgacgcccgggggcctgagccgttccagtacgaccgcgagttcgtggtgatgctcagcgactggagcgacgaagacccgaccagcctgatgaagaccctgaaaaagcagtccgactactacaacttcgacaaacgcaccgtcggcgacttcatcagtgacgtcagcgagaaaggctggggcgccaccattgccgatcgcaagatgtgggcagaaatgaacatgaaccccaccgacattgccgacgtcagtggcgccacctacaccttcctcatgaatggccacgcgccggacaacaactggaccggcctgtttcgccccggggaaaagctgcgcctgcgcctgatcaacggctcggcgatgacctacttcgacgtgcgcattcccggactgaaaatgaccgtggtcgcggcggatggcttgcacgtcaaaccggtcagcgtcgatgaactgcgcatcgccgtggccgagacatacgacgtcatcgtcgagccggacgccgaggcgtacaccctgtttgcccaggccatggatcgcagcggttatgcccgtggcaccctcgccactcgcgccgggttatctgcgtccgtaccggtactcgacccgcgcccactggtgaccatggacgacatgggcatgggtggcatggatcacggttcgatggacatgagcgccatggatcactcggcgatgggcccgatgcaagcccatcccgacagcgaaaaagacaatccgctggtggacatgcaagccatgagcaccgcgccaaaactcgacgacccgggcctcggtctgcgcaacaacggccgtcgcgtgctgagctacgccgacctgcgcagcactttcgaagacccggatggccgcgacccgagccgcaccatcgaactgcacctgaccggtcacatggagaaattcgcctggtcgttcaacggcatcaaattctccgacgccgaacctttgcgcctgaagtacggcgagcgcatccgcctggtgctggtcaacgacacgatgatgacccacccgattcacctgcacggcatgtggagcgatctggaagacgaaaacggcaatttccaggtgcgcaaacacaccatcgacatgccgcccggcacgcgccgcagttaccgcgtgaccgccgacgcactcggccgctgggcttatcactgccatctgctttatcacatggaaatgggcatgttccgtgaagtgcgggtggaagcatgaaggggccgttgatgactcgattcactgcgttttccttgctgctgatcggcagttcggcgatggctgcaggcgacatgccgggcatggatcacagccagatgtccgacatggatcacccggccatgcaaagcatcgacgacggcatgatgcagcccgccgcgccgaccgaaagccgcacgccgatcccgaagttgaccgacgccgatcgcgccgccgtattcaccagccccggcggtcatcaagtccacgacagcacgatccacacgtacttcctcgccgacaaactcgaatggcaggacgccgatgacggcagcacgttggcctgggatctgtccggctggatcgggggcgacatcgatcggctgtggctgcgctccgagggcgaacgcagcaatggcaaaaccgaagatgccgagcttcaggcgctgtggggccatgcgatttcgccgtggtgggacgtggtcagcggtgtgcgtcaggacttcaaacccggcgcgccgcagacctgggccgcgttcggtttgcagggcatggcgctgtacaacttcgaagccgaggccactgcgtttattggtgaaggcggccagagcgcactgcgactggagggtgactacgacatcctgctgaccaatcgcctgatcctgcagcccaccgtcgaagtcaacgtctacggcaagaacgatgcgcagcgcggcatcggttccggccttgccaacactgaagccggcctgcgtttgcgctatgaaatccgccgcgaatttgcgccgtacatcggtgtgacgtggaaccgcacctacggcaacagcgccgattacgcccgcgaagaaggcgaggatcgcagcgaagcgcgagtcgtgctcggcgtgcggctgtggttctgaattcccttagaaaacaccccagaggtcttgcatgcgcaccttgaaaatcaccctcgtactcgccagcgccttgctcctgagcaacctcgcccaggcccacccgaaactgctctcgtcgaccccggccgaaggggccgacggcgccgcacccggcaagatcgaactgcatttttccgagagcctgctgacgcaattctccggcgccaaactggtgatgaccgaaatgcccggcatggcccattcgccgatgccgatgaaagccaaagtcagtgccggcagcgacccgaaaagcatgctgatcaccccgctctcgccgttgcccgccggcacttatcaagtccaatggcgcgcggtgtctagcgacacgcacccgatcaccggcaacgtcacgttcaaagtgaagtgagcgatgggcgaactgatcatcatcctgcggtttgcgttgtatgtggatttgctgctggtgttcgggctggcgttgtttgcgctgtacagcgctgagacgctgctgcggttgcggccaatgctgcgcgggatggcattgatcggggcgttgttgtcagtggcaggattggtgctgatgaccagtgccatgagcggcgaaaccgcgctcgcggcgctgtggccgcctgtgcaaatgatggtgttggaaacggatgtcgggctggcgtgggccgtgcggatgactgcattgatcgtcgtggtgattcggccgggtttgaggcttgcatcgtttgccggcgcaatcgccctcgcctctctggcctggagcgggcatggggcgatggacgagggcgcgctgcgcttctggcattttctcagcgacattctgcacctgctggcggcgggtacgtggctgggggcgatgctggcgctggtgttgatagcgcgggggctggttgatgaagcgcgcattcgttcgctggcgtttgcggttcggcgctttgagtgggtcggcgcagcgattgtgctgacgctgtcgatcaccggcgtggtgaattacttgttcatcatcggcccgaggctggatgaagtgttactcggcacgtacgggatgctgctggcgatcaaggttttactgtttgccgcaatgttggtgttggcggcgttgaaccgctttcatctcgggccggcattggcgcaagcgttacgcgatgggcagcatgtcgtcgcggtcaatgcgcttagacgaagcgttgtcgttgaactggcaatcgcattgctgatcgtggcactggtggcgtggctaggcacattaagtccggacgcgggatgacacccgggaaagcctttcactacactgggccaccttccttttcagaagcccatttgcaatgacaattctaaaaagcacgatgatcttctgcggcctgctgaccctggccgccggcgctcacgcagagcaaaaccctgcacacctcgacagcatccagcaacagggtgaactgcgcgtctgcaccacgggcgactacaagccctacaccttcaaacgccccgacggcgacttcgaaggcatcgacatcgccatggcgcgctcgctggccgacagcctcggcgtcaaagtgcaatgggtgcaaaccacctggaaaaccctgatgccggacatgcaggccggcaagtgcgacatcggcatgggcggcatttcggtgacgctggagcggcagaaaaaagcctacttcagcaacaccctcgacaccgacggcaagatcccgctggtacgctgcgccgatgtcagcaagtaccaaaccatcgagcagatcaatcagccgaacgtgcgcctggtcgagcccgccggcggcaccaacgaagccttcgtccacgctttcctgccgaaagcgcaactggccctgcacgacaacgtgacgatcttccagcaactgctcgacaacaaagccgacgtgatgatcaccgacgcctcggaagcgctgtaccagcagaaactcaaaccgggtttgtgcgcggtcaatccgcatcagtacatgcaatatggcgagaaggcttatctgctgccgcgcgatgacatcagttggaaactgtacgtcgatcagtggctgcacttgagcaaagtcaccggcaagtatcagcaaacgctaagcgaatggattgccgtgcctgccgcgcagtaatcctcaatcgtcatgcaacatgccggagctatattgattgagactgctgccgatactgttgccaccaaacttcaacgtattggcgttgcgcccctccggcgactgacaatcgccggagaaacaacgggtggtggtcaaaccacccgcgcccgaacaggcactcaacaccgataccgttgcagcgatcaacagcactttgacgacattaaggcgcatggcacgattcccctcgggatgaacagcgacgatcttgccaacatcctaggcccgcgccgcaatcggcaagatgaaactttgctgatcgacagcgccggttcagaatcgcttacccgccgaaaaggacatcccaatgcaattcctgcccctcaccgacgccagccctgctgtccaggcccacgtccgcaccctgcgcaatcagccggacgtgcgcaaattcatgtacacgtcgcacgaaatctccgagcaggaacatgcgaactggctgaactcgttaaagggcaatccacgccagcaagtgtttgtggtgatcaaggatgagcaggcggtgggggttgtttcgttgaatgcgatcaatgatttgcacaggaccgcggattgggcgttttatctggacgtggggttgcagggtaagggcttgggcagtgtcattgaattctggatgctggattacgcgtttggcgtggcggggttggagaagctgaattgtgaagtgctggcgatgaattcggcggtggtgaagatgcatcagaagttcgggtttgaggttgaaggtgttcgccggcagaacatcttcagggatggtgcgcggatcgacgttgttctgctaggtattaccaaagacgaatggcaacacaagcgccctgctttggcgcctgtgatcgagcggctcaacgccgtttaaggtctggagcattgcgattgaaacgtgaactgaaccctgccgacctatacaaaatccgcgcagccctctccgatattttcgtcgacaccggcgtcgattatccctacatcgcccgcgaagtcgaaggctacgacccggaacaggttaaagacattctgtatgccgaagttgccgtcgtctgcgcgtggaacctggaatgtgtactcccgccggtctggacaggtttcgaactcgatgcgttgaacagggacatcgagcaaatgctgctcgcaaacacgaacagctggattcggcggcaactgcataagctgcacaccgcgtggttgcgattcagctatcgggaagtctgggcagagattaccgctcactgcaaaggctggaattaatacagccctgcgtggcaatggcacatcaacgacatacaacgcgttgaaactgaaaagatgattgcccctctgcccgttcagtcctttcctggtttaggaatcgcaatccggctcccggtcttgacctcgcgcaacgccaggctggactgaatggaggcaatccccacctgacgcctgagcacctgctcgataaagtcgctgtagctatcaagatcttcggccaacacctgcaacacataatcggcatcgccggtgatcttgtggcaggccaccacctgcggcagttgcgcaatcaccgcctcgaaagcgtccggcgcgtggtcggcgtgggtggaaaaacgaatgtgcacgaacgccatgatatccagtccgagcattcgccgatcaaggttggcctgatagcccttgatgacccccgcctcctccatgcgcttgcgccgccgccagcacggcgtaaggctcagcgacagccgctcgctgagttcagcgttggaaatactggcgtcctcctgcaacaactcgagaatcgccaggtcggtctcgtcgaggctgatgcgtttggatatttttttctgcatgacgccattcctgagtaaaaacgcccgaacaatcgaccaaaccacgaacacaaagcaaagaaagcgcagcccagccggaacagaatatttgcactggctcacaataacggatgcgcagaatgtttacagttttcagtgattcccatcgtttgcaccacggcaccgaattgaaggacggcgtgctcaaaccgtcgttcgaacaaccgagtcgggccgacaccgtgcacaaccgcgtgaaacaggtcggcctcgggcagatcgtcgaaccgcgcgcgtttgaccgctcgtgctacatcaacgcgcacagcgagcgctacgtcagttttctcgaaactgcctggggcgaatggtgcgccaccggtcgcactcacgacgccttgccgctggtgtggccggtgcgcgatctggccggcgaagaggtgccgacgttcatcgatggcaagctgggtttctatgccatggatgctggttcgccgattaccgcgacgacctggcaagcggtgaaaaccagcgccgatatcgccctcactggcctggccctgcttgatgaaggccacgacagtgccttcgccctgtgccgtccgcccggccatcacgccgcgcgcgaatacatgggtggttattgctacctcaacaacgccgccattgccgcgcaacaagccatcacccaaggcgccaaacgtgtcgcggtgctggacgtcgactttcatcacggcaacggcacgcagaacattttttaccagcgcagcgacgtcatgttcgtctcgttgcacggcgaaccggcggtgtcctatccgtatttttcgggttacagccacgaagtcggcgcgggtgtcggcgagggttacaacctcaactatccattgccgaaaaacaccacatgggagagctaccgcaacgccctgctccacgcctgcaaaaagctccagcagttcgcccctgaagtgctggtgatttccctcggtgtcgacacgttcaaggacgaccccatcagccatttcctgttggaaagcgatgacttcatcggcatcggcgaactgatcgccagcgtcggctgcccgaccctgttcgtcatggagggcggctacatggtcgatgaaatcggcatcaatgccgtcaacgtgctgcacggtttcgagagcaaacgcagctgagccagctcgcgctctacaacctttcaatgactggatcggagaataagaccatgacgctttttattgatgtcgatgatgctgcacgcctgttcacccaggtcggtatccgccgcgcccttcgcgaaatggccggctacatcgaagcggattacgcacgctgggcgcagtttgataaatcgccgcgcactgccaaccattcggcagacggcgtgatcgagttgatgcccaccgacgatggccagcagtactcgttcaaatacgtgaatggccacccgaacaacggccagcagaacttgctgacggtcatggctttcggtctgctggcggatgtgcagagtggctatccgatgttgctcagcgaactgaccttgaccaccgccgtgcgcaccgccgcaacctccgcgctggtcgcgcaatcgctagctcgtccgggtgcgacctcgatggccctgatcggcaacggtgcgcaaagtgaattccaggcgctggcctttcatgaaatgttgggcatcaacgaaatccgtatcttcgatattgatcgcgacgcttcactcaagttgaagcacaacctcgccgcgttcccggacatcgacgtgattctggccagctcggtgaaggacgcggtcaagggcgcggacatcgtcaccacggtcaccgccgacaaagcctacgcaaccattctgacgcccgagatgatcgagcccggcatgcacatcaacgcggtcggcggtgactgcccgggtaaaaccgaactgcacgccgacatcctgcgcaatgcccgggtcatcgtcgaattcgagccgcaaacccgtattgaaggcgacattcagcaactggcagccgattccccggtgatcgaatttttccgcattgtgcagggcgaagtcgccggacgcgaaaacgacacgcaggtaacggtgttcgattcggtgggttttgctctggaagacttttcctcactgcgctacctgaatgacctggctcaggcacagcaaatcggccagcgcatccacctggtgccgacaccggccaacatcaaaaacctcttccaactgctcgatccgcaaccggccaaagcctcgcatctgcgcaccgtcagttgattgccaatcgccgcccccaagccacagggggcgactcaccttgtgattagccgctgcacctctaacaagaacgctcgacacctactttctgccaaaactcaaaaacataaaatcaagaggttttgcaatgaaatcgaccccttccgggctgcctgaacagcccgcgctgcagcgcacgctcagcaatcgtcacatccagttaatggccatgggcggtgccatcggtaccggcctgttcatgggctccggaaagatcatcgcgctctccggaacgtcgatcatcctcatctacatgatcatcggcctgttcgtgtttttcgtcatgcgcgccatgggcgaaatgctcctgtccaacctcaacttcaaaaccttcgccgacttcgccggtgcctacctcggcccgcgcgcggcgttcttcctcggctggtcgtactggctgagctggagcgtggcggtgatcggcgatgccgtcgtggtcggcggattcttccagtactggttccccgacgtaccggcgtggatacccgccgtcggcatgctggcaaccctgttcgcgctaaacgtgctgaccgtcaggctattcggtgaagtggaattctggttcgcgatcatcaagatcattgccgtcataaccctgatcggcgtcagcaccgtgctgattgccagctccttcgtctcgcccagtggcgtcaccgcgtccctgagtcacctggtggacaaacaagcggcgttccctaacggcttgttcggcttcttcgccggatttcaaatggcgatcttctccttcgccggcaccgaactgatcggcaccgccgccgccgaaacccgttcgccagagaagaccctgcccaaagcgatcaactcgattccgctgcggatcatcctgttctacgtcctcgcgctgacctgcattatcgccgtgacctcgtggcaacaggtttcccctgtcaaaagccccttcgtcgaactgttcctcgtcgccggtttccccgcagcggccggcatcgtcaacttcgtcgtcctgacctcggccgcctcatcggccaacagcggcgtgttctcatcgagccgcatgctcttcgggctggccaaccaggacaacgcccccggcatattccggagactgtcgagcaacagcgtgccgctgctaagcctggcgttcaccacgctgttgatgctggtcggcatactggtgctgttcatcgtgccggaagtcatgaccgcgttcaccatcgtctccaccgtgtcggccatcctggtgattttcacctggtcgaccatccttgcgtcttacatcgcctaccgcaaaaaacgcccggatctgcacgcgaagtcggcttacaagatgcccggcggtgtgccgatggcttggttctcgttggcgtttttggggtttgtgctggggttgttggcgttgaggcctgatacgcggattgcgctgatggtcatgccggggtggtttgtttggttggggattgcttatcagttgacgcggttgaggaagccgaaatctgcggttgagtcggctagtcagtttggctagatctgcaagcgaaagccgtcacctgggtgacggcttttgttatcagtgaaagagcatttcacctgcccaaggcgggacaggatttacgccttcacctcaacgttatccaacgcctgattcaccgccaactcacccaacatcacaacctgcgcgatgcccaacgcggttttgcggtgtgaggggtcgagtgcggcggcgaagttgttgagcatttcggaagcggaactcagcgtttcactggcattggccagcagggattccgagtcgtactttgggttggcgaggtacatgcgttcgggttcgttgacgctggccatgatgtggccggcgggaaggagatagtgatcgagggcgcgttcggcggcttcgtggagttttttggagttgagggattcgtagggggatgcgggatcggtttctggtgggttgggcgttactttgaacatagatggaacctctagcgcgattactaaaaggagccatcacccacgctaccaaacgatgggtggcggccatacgcgggttggtagaccggtcgcactagaacccggcgcccacgaatgggccccacgcatgaccaccatgaaatccgagtcctgggaaagcgactgatattggtgatgcgatgcatctagacacgaagcgggctaccaaacccgatcactgggtttcagtgatgtggggacgatagagcgtgagggctagacgcacaagccgggggattctgtcttaggtgtagggggaggcgcaaggtggtgtaggccaaggacgtcgataccgagctacttttaaacatgttgaaactcaatgcttagaatcgcacggaagaccttaaaataagcgttctgctttctgacaaataaacctgtcgtcactcattgaggccagacaatacatatgccagagtacgaagcgggctatgctttaaattaatgccgctagtaacggctcaaggaagacgtcgagctcacatgccatgcaagctctgacgttcaaacttagctttttgtcttcaatgattggctaatctcatagtaacaatccacatagtttcctatttcgtcatagatgagcttctggatctctgctttggcaacattgtattgctttgctgcctcctcctgcgcagtcacagctgcttcaaaagctcccatgttttcaatgatgacattcagctgctctctagcaagacgatataattcgcccatgctaacgattttgtgcagctgcccaggaatcggccttagcctagtatacgtggaatacttcctgttctcttcttccgagttgtatcttgactcataccttgtgaagtactcatagagatcaatttgctctcgaataagcgcaggcaagcttgatgttatgaatttctcaaacttatactgagcactacctaaatcctccatagacataaacccggcaaaactctcaatcactctaactaccggctgccttaatacaaaactagttctaactcgcatattcataggtgaagctttgtcttcaaggtggtctgtaaagtctaaagccttgtagtccagcttggtggcagactccacaaatttcttgtaaacttcatctaacttagataccttgcgtcgaaaaccggcaaaaattggagccatcttgttggatgtcgccctgatttcaacagtattaatttgggcggcgagatatgcgagggcgtcagagttttgaggctcttcagcggcgactgctgcttgcattatcgcgtcaaatactttatctaatccatgttcagctatgtctgccgctacaaaatcagaaatcccagaccaattcgacacgtatcactccattgtattgttgcgttaatctttgattttatcagcacggccatttacgggcaaactttgcaatcggcaaactctgaccaactgtaaatatctcgctagcttttatttaaaaacaattacatagggtgggcggatttattaacttccaagcccgatacctataaataaatccattactttctattataccaaactactagatccccaagcctttcttaacaagatctccaagtaccggccaaataacaggctgcatacctacccacgccgggccgcatactttttcaagtaaacctttagcatttttcccattaccgtcgcttgcttcttctattgcagaaattagatccttacgactctcaggagagacagttagtccttgcccctctaaaatactgaccagctttagtaaaacatcgcctgtttcaccattagccacatccattttttgagctgtataatcgccagccgatagctgtaagtttgtaaaagtccctccggaaatatgaacattatttacggtgcgctgagcggtattaggtcgattagacgcctgtcgagcggctttatagccaagctcagtcagaccggcatattctcgcttactgtagccacctataaatattatgccgctatcaggtggattatcaataagagcataaggtcctgtattgatcagtttctttttttcaaggtctgcaaacgcaatatcaaagtcgacttgtgtaatatcatcgctggcacagatggctgctgccaaaatagtaacttgcggcccctcgtatccatcacttaacttttcagagtttagcccgcgacttgaaaaatccactaacagagcgccaaggatttgtttttcagcttcatctaggtgtgcggtcatactcattccttttttgaaggggaattaccaaacttatcaaaaggctcttgtaagaggcttaatgtggcatgaaaatgcggcggggcacaaccacgcttgagccaaaattccatcataaaaggaatcatgatctgaagcggtcggtactgaattcccgtaacttccaaatccccatcaccttcaaccctttcgaagaaaacccgcctcggtgcaggggcagggtttcgcagtacttcaacctctcaacaacgccaagcgagcaccatgcgtgacccgccgggggtgatatgcaggtgctcagaaaaaacgccccttataccccgcaggcaaagtgggggggggacgacggcgcgcgccaagtgagaacattgcgccccgacgtcatagcgcaccaattcagagcaaggccagcctacctcccccctcacgcctcacgcctcacctcatgcgatttcgcatcactgaacttggattagccagcaggcttcatacctatgatcgtagaaagcgacccgaaacaaaattcgctctgtctcattcgaaggactgcaattctaggctactctcccattgatggatttattgtcaaacgctctacttagtatcaattgagaccagaataaaactgctaatccaaaaatacaaaaatactctggagacaggaatgatcaaaggaatttcaaggataaaaggattgggcgtttacgataactacaccagaccaccagacatccaggaattcggaatcaagaatcttatctacgggtggaactattctggaaaaaccacgctctccagactatttgcccagcttgaggcaaaaaaaataaataacgatttaattggatgtgaatttagcttcgagacggacgaccagccaattacagaaaagaatatcgagcaaagcggcttaatagttcgcgtattcaactctgattttattcgggaaaacttacacttcgaaggaagcaatttcaagccgatattacttctcggaaaagagtctgaagatgcccataaaaaaatcgacaacatcgccgatcgagtaaaaaaatccgagagcactcgcaaaaagctagacgttcaaaccaacgctattacacaaaccatttccaatgccaaaactgacgcagccaaacatattcgccagctccttaaaattgacccatacactgcgacgcaactaggaaatgacattacaattgtaggagttctaaattttaaacttcttagcgacaaggaattatctgaaagcactgagctttccctaaccccggacagcaaaaaaccaagtaccgttgaaagagtcgaactcgctccttccattgaaagtattcatcaagaagcaattaggattcttgctgcagtgccgacctttgccaacacgatcaaacatctcgaagaccacccggaaattgagcgttgggttgagtcaggcctgcacatccacccacatgaaggcacttgcgagttctgcggaaacactatttccgaacacagactcatcgaattccgtgcccacttttctaaggatctggcggagcataaacagaaagtcgagtacctcctacaacgtgtcaagtctgccgagcttaagctctcgctacctaaagaaggtgagttcaatccacaatttagggatagctataaggctgctgccgagtccttaactccggctctcaaaactttcaacctcgcggtaaaaacccttatagatgacgtgcagcgcaaaatcgatgcgccacgcaagctgatggaaccaacccttttggtcaatgggttagccagtgacgtcaccgcctctgtcgctgctatcaataccgtaatcgatgaaaacaaccaactagctgacaatttttccacttccaaggcagcagccatcaagcaagttaggtatcactacgttcaacagttcgtcgactctcaagaaaaggctggatacgaacgtaaaaaggcacgattgatcaaacgtcgtgaacaactgcgccttttttccgtgaaccttcaaggggaggtcgaaaagcttcaggcacttatcagtcaagctcagctaggccgagaaaagataaatgagcgaatgacatctatgttggggggagaggcggtccagatagtagttataaaagatccgaccacgaacaatgagcagttcaagctcgttcgcaagggtggcaaggtagcaaagaacctaagcgatggggaacgcaccgctatcgctttctcctacttcctgaccaaacttcaagaattaaaacccgaagacttcaaaaacacagttgtatatattgacgaccctatctccagcttagatgccaatcatatttttcaaatcacagctgcaattcgcgcaattttcttcaagaaagaaaatgaaaatgccgcatgggagacaacttgcaaacaactttttatttcaacacacaactttgaattttttaatcttttacgtgaaatcaagcccgaatcccctagacaaggggccagattatttctgataaaacgtataagcgaagcacaatcaacactcaataacatgcctgcctcactggcaaactaccagtcggagtatcactttttgttcgaggttatacatcgcttccatcaagctccggacaagacagatcacacaaccttaatgctattaccaaatgcaatgcgaagatttatcgagctatatacctattcaagattacctggaattatgaaagagacggtagaccaacgagcagaagcattatttggactcgagaagtcaaaacgtattttgaaggtctttcattacttcagtcacgccaacactattgatagactggctggaaacaatgaacttatcttcgatattgagcatgctgtgaaagatcttattgaggccatcacgcagaccgaccagaaacacatggatgcactgattgcgtccctctaagaatataactcatagattgggtacgcttaggcttccgccctccatgcgcagtggggcctgcacttagttgtagcactcgggttgttcgagtaattcagcgtggagccggtgtggggcaaatagggccacctcctgagggattcgcgattttccttgaataaatcaaaaggttagaatgttgaagaggcctgcataagtcggcaacttggtttgcaccacacaaatacaagaaaccgaccccatgcaagccatccgtttttgaacagagcgatcgctcaagcactgccctctatcgattctcaccgcctgacatcactgatgagttgtgtcacttcgttactgcatggacgtcgcctgacactgaccgctcttggtcgcttcagcttgggactctgccccaccccattcctgataaactctcccaccttcacccctctgatccagattcccccaatgcctctacatcccgccccactctcccgccgcttctccgtcgccccgatgatggatcggacagataatccaccaaagccttacaaataaaggcccatcctccattcaaaaagcatctgtaccagttacgtaccagtaagatttttcctacgaataattacgtttcttgcctgtttctctgcagcaatttttaagcagccattttcagctcccatccggacactaccgacactgtcaaaacccagtcccattttgatgaattgggtgcagtctgcccacccaggtcgaatagctgtagttaacccttttcaaccctgacatggatcgatccgtccccctcggtagagaaagaaatccgatcgatcgtacaaccgagagcggaattacaccgccatgtttaagaggttaattaaggcatcagggtcaataaaatcaagaacttaacacccagtaaaacccattaattcgtcccaaaacggaatcattggtacgaaatatggtacgcactccgcctcaagcaatatttagaagctccgcttagctgtgaacaagcgggcttttcttttcagcacactggctgaaccttgttttcaagcgtatcaatcttacaaaaaccagagtttcattcgtttctctacgcaaatgcctgttccgttagtattttttctaatatagtcaccttttaatcaaagcgatttcgaaatggatcaacgaaatgacactccagagcctacagacagtggagtctctggcacgcaagagaaaggtgaggagtcgacgggcgtcatagaaatgcttctccccttgggtaagcagtctctacaggacacttttatcggacttacagcgactcgaccaaggaattttggaggtgattttaatgccactttaatagcaggcatgatagatcacttttctcaagagtccatagatgccaaagagtcgctaaaaaagaaaaacgaagagcttagcgaaaagattgatgaactatctgcagcaagaattgaaatcgccacactcaaagaaaaacttggagctgcagcaagcctgtcccgaataaaacagacttgcacattcgccggcactgtagtcctaggaatagcagtagatctttacaaaaacaatttaaatatctcttacttagttggatctatcggagtcatattgattggaatgactattttcatagataggaaggcaaagcaatgagcatgtttgacgttgaacacttagacctggttgacgtgcttgacaagggctctccaaatcttgaaagaattgcaatacgggccatggcggattgtgatcttcgcgattatatattactgattggacacagaaatattgacggctccgcctcaccaatcaaggacaacatgctatggtttgggccagcactaattaaagaaggagattggatttttgtttataccgctccgggacaaactagaatcgaaccaatcgaaggatcagctacacgctctaagttacatagcattcactggggcaaagatcatacaatcttccagaatggcgcccttgttcctatgctttgtgaaataagcgcagtcgcaataccagagatcccaacaccaaaaaaacatgacaagcgattaacttattaaaaagaatccaagcacactctattgtgcttggactcttattatatatttttaattcctatatgctgtgcgttgattagccaatgatgaatttgggcttaatcgatctgctgcactccggccagcctagcaaccccctcaagaccgcattcctttgtagcaatttctaagcctgcagcaattatagccgacatctgttactaccagtaccatgctgattgtttggtcgataggagtcgatgctatgtcagacgaatattagttatcggaattaaggaaagcatttacagaattagctaaccataaactcgcttcagagatgtcagggataaacgaggcaggagtaacgtacgagaccttatgggcgattggttagaccgcccggcagatatacaaagcttggcgatgctgacggataagaatacgcgttaaattccgatcactctagccacacccgaccaaagaggttttcagcctaggctcacgagcaaaattacaccgtcaagccgtacactacaaaaagccaacgcatataatcacagattacgctggtgagaattcggttatgctaagcaagaatcattcatgaccacctacatcaccacaagtcatagttaaatcttagcattgcatagcagttccatgtatcgcactacgcgtgcctgaacaatttcaatagatgcttaaagttatcttttacgcacccagttacgatcaccccgttcgtacggctttggcagttcaataaatcgcaatcagcgcaagtccgttatgcgctcagaaaactctctgacggcgcctctatgcagatccacagaaccttaaaacgcatttcacttgtgaagaccctacctgagagcaatgtgctaccattgacgcacaacgcaaactgggaatgcacgccgtgcttgagggaataatgagcaataaagaacaagaaatactaagccacatcaatagtcttttacagcacgaaaacagtgaaaagccgaatttacgtcgaaaagacgacttcactaaagtcaatgaggcgttcattttaccgtttggtaatggacgcgcgtactctatggattcgacaggaagagtaactgggctaaagttaggacgagtagacaaaaacatcgctgagattttagatctgatatgcgagcttattcatgtaaagcgattagttattttcgctaatcagaactacgacatcccagacaaaatccttagattgacggaattagatttcctgtgggttggcggcgccataaatagattgccgcagtccttattctcatcactctctcccatcattgcagcgcgtaacccttccgacgcttcaatcaatagctttatgtctaaagatctaatcgataaaatttccgctaagtccttggaagaagagcctaacaaaaaccgaaagaaaaatacgacaaagcaatctataacagcaatgcacatgctgagcgaggaaaagatcgaacgctcaccatttcattccgaaataatcatagaattgcaaagagccgtcggacttcatgtagtttctgacaagttatctgacccgccttttgaaatattaattcatggcgctgacgcagtaaacaactactacatagaaagaacgaagcaaagtctcccactgaacgaattaaaggtaatacttgtaggtaatggcggcgcaggaaaaacatcgctagtaaaacgtctaatgggagagcctttcgactccagggaacaacaaacccatggcatcaacataaagaaatggactctacctactaaggacggagtcgacgtaaaactgaacttttgggattttggcgggcaacaaataatgcacgcaacccatcagttcttcctatctaaacgcagtgtttacatactggttttggacggaagaaaagaagaagaccctgagtattggcttcaacatataacaagctttggcggcgattccccagttttcgtgattttaaacaaagtagatgaacatcctgctttcgtagtaaatgaaaaatttcttctggataaatataaaaatatattaggcttctacagagtctcttgctcaaaagatacgggcatagatagcctggtaagagacatgcgctctaatctacctgacatcccgatgataaagactcaatggccttattcttggtttcaggtcaaaaaagaattagaagaaaaagggactgaattcattaccctcgatcagtaccgtaagatttgcaattcacacaacgtaccatccgaaagccaagatattttggtcgacttcctgcatgatctcggaattgtattgcactttagagacatccagcttttagatatgcatgtcctcgaccctcggtgggtcactgagggcgtttatagaattatcaattcaaaaaaacttgctgagcaaaatggcgtacttaaattagacgctctgacggacgttctaaaactcgagaaaagtcttggatttatttatcctcctgaaaagcattctttcttggtggatttgatggtgaaatttgaggtttgttatcgtgtaagcaacgactcaatccttattccggatctattagacgttcaagaacctcaattcaactttgatgagactgacgcattaaaatttatatttgaatatgactacctccccaaatccgtgatactgagaataatcgttagactccatgcggacatcaacaacatggaaagatggcgcacaggtgttgtattgaaaagctcgaccttctcaaccaaggcattgattaaagctgacgacaaagagaaaagaatatatgtcactgtttccggccttggcaaacgcgatttctttgccgtaataagacaaacaatattcgatatcaacctttcatttgagaaactcggcttcagagagatggtcccgttgccggatgaaagcggacacatggtcgactatgctgatttaatcgggtgtgagcgtgccaatatagatgaaatgtttatagggagactaggacgaagctacaacgttcaaactttactcaatggtgtagaaaagaaatctgaccgcgatacgtcgcagataataaatgttaacggcaattacttcgctggagaagcaacagtacaaaatgcaactggcaatataaatacacttgaggagccttctatgacgcagcacaccgccagcacttgggaaaaagtggtggtatttctttcgctagcaacatttctagtgcttttcggttatttattgattagaaatactgccatcgaccccagcttagcggtagcgcttagaattgtaatgagcctgcttgtcgctgttttcggagcgacggttcctggctatatcaatgttggattttctgcaaaaggcttaacagttagagctgtaggcgcagtcgcccttttcgtattaacatatgtttatacgccgacagtttaattgttagccgtctcggtggtgcgccctgtgatgggaccagaggtaattgactaatattgccatctactcagggtgtatcaccgagacaagctaattacattcttcaccttcaccccatattgattaaatattacccgttgtaaggcttagaatagctacgaagcaaaaacccataacagcccccactccgaagggctggaaatagctggggattcgaacccctgcctaagtccgcacagaccgcttcaggccagcaaaataggagtgatacccgttaatcgatggcatgtcgcggcctattccggcccacgatctgccctaaatttgccctaaaacaatccgcacctacaggtactcgaccatgacgcgcaggtccaccagagtgcgcaacactgcttcgtgaatgccttcgccgatcactgtgcgtgctcctgacgccgcgccgtggccgccgcctcgaaggccttgtgcaaaccttcgatactggccgcgttcagcaccttgaccgtctccaggcccaggacaaaaccgtcggcgcgatcactggcgcgaaacagatcgtccgccgtgtgtgccagggcaatttggtgcagcagtttcagggtttgaacctccaccgcgttcggtaagttcaatgcggacagtgccttatccatgctgcccctcgttcgattcagcgccgttccccggcggcgcaaacccctgctcgccggattcgacatcgatcagcaaccagccgcccagcggttggttgctcccggcaacaatcaacccctgcaccatcagcccgtcgggcaggatcacccgcagcatgttggcgtccttgggaccttcaagaaagtgcgccagttcgacacgggtgcgatcgagggcaattttgctcaagcgcaccgggccattcaagcgtcgttaactcggcgggcggacgcccttcgtagcgggcaatcacggcaacggtggccaagccttcaaagacgtgagacatgagtcgggttcctaagcgagtcagtaggcgtcgaggggaaaaccagagggtctgttaatggtagaccagccctgcggggactggttgccacggccataaaaaaagcccccacaccggggtcaggtgtggggcccgattgaaaataggctggaattcaatgcaccgatcgtcgaaggccgctatcggccagcgacagatactcaattttgtgtatcaagctactaggaaattatcgcgttcagcatcaactctagaagtctttttcaattcgctctaaagaaataacatttgacctcaactcttgaagctgagcgccatcgtattctccatctgtctccatttgattcaatatagtaaagaacgctgctcgatcagcctctttttgcactatcacataattgatatctttaatatcgaaacgcagaagacaattatcaaaagtatatttattatagacgtcttgttcagcctcaaacttttgaatgggtatgcattttcgcccttgcggaagagttggtgtaaatcgccattcattttccaaatagaagtctttatcggcctctccccctccagaacgcgtcattttaccactcaatggctttatgagagctaacaactcgaatagatggtcaatgaacttaggcacctgcgctggcagcacgaagtgttcaggctgagctagatttaatatactgtatctaagtgcgctattttcagacaaataaattacaggattcaagcgcgcccggatcgcccattctctagacattccgaaaccaaacccaccgtaaaaacccacatgatcttttattcttgttaatggtatatcgcaaaaactaactaaaggataggcaacataacctaactgttcgttataccacctaaaatcttccgagcaataacgaggccaaaatcctgtgcgaataatttttgcaagcgtttcaacactatctgtgaaatgaaataaagtatgtgattttgagcccacgcttcagattctccaagttaatccctatcaggtatcataatcacaaaacaataagcaaagtttttcaaaaatctacaaaggccactttggatcgaatgctacctgccagggcgattactaaaactgccgtagtcgcgtaatcgcatctgtaatcactctcgagtttgtatccaaggtttccatggccacaactgcgttttctgcaacagcctctacgccattctctgaaagccatttcgcgacctcctctattgccgcaccaagcgcatgctggttgtgcagcagtaatgtcagagcgtcggccgtggcgatgttggcgtctgaatcgtagggcatggaattcgtcctcggagttgggtttggaaagcctagctcatctcgtcgccggcgaaggccagtcgctcgttcggcatgcctcatttacgcaccaaaatagcaccccagtcccatctcagtcccatatggcctttttcagacgccaaaaaccacaaacccccggctttctctagtaaaatcatgggtttgcgtttactgaatgtggcggtgaaggagagattcgaacgctcaacacgtatgaagcgatggcaaacacttaggcacgtattcgttcgaccgcggcccaaagcgaacgcccattatcgacagttaactgtccacaactggtccaagcgcgtggtatagctttggctcatcatctcccgtcgcatgccccaatctggattgctcggcacactcgcagctcggagagtacccctaccccatcgcccattgatttcgtccaatacagccataaccctagtcgcctcagtgggctgagaaatggcgaatagatcgtccgtgtattcgcccggctggcatagattcagcagcagaacttccgctttgctgtaactgaaaccagtacggaatacgcgatcaagtgcattgaccgctgccgtcgttaatagccgaacgtcatccgttgggtacggtagatcgatcacgacaccgtttgcgtatttagcctcatcggggttgaacatgccggtgcgaatgctgacccggatcttcttgcacagcgacttttgtgcccggagcttttccgatgcccgcatcatgtaggttgccactgcctccttgatcggcggcagctccttcagtcttttgccgaacatccgactacaacagatctcttgcttgggcggatctggctcatccagctccaggcacggtgtgccagccaattcccgagcagttttctcaatcactacactgaaattttttctcaacgtccacgggtctgcgttggacagatccatggcggtcttaatccccatgccgtcgaggtgcgatttcatgcggcgtcctactccccaaacctccgctacgtccgtgttacgcagcacccagtcgcgcttgattgggtcgcagatgttcacgactccaccggtttgcccctgcaagcgtttggcggtgtagttggccagcttggccaaggtcttggtgtgcgcgataccgacaccaacaggtatacctgtgcagcgcagtacctggctgcggatcttgcggccgaggtcgtccaagtcattgataccggtgaggtcggcgaaggcttcgtcaatgctgtacacctcaacggccggtaccagcgactcaatcagggtcatgacgcgttcgctcatgtcgccgtacaacgcgtagttcgaggagaacgggacgatgccgtgctgcttgagcttgttcttgatctgaaagtacggctcgcccattttcacatagggcttggcatcgtagctgcgggcgatgacgcagccgtcgttgttcgaaagcaccacgatgggcaccttggcaaggtcagggcgaaacacgcgttcgcaactggcgtagaagctgttgcaatcgattaggccgaaaaccggcgttgctttagacatggctgcgcacgctgccgatgatcacgccccagatggccagctcatccccttccagcacgtagcgtggtggatacttgggattctccgacaaaaggatcacatcctttccgcggatgcatagtcgtttgcacagcggatcgttgttcagcagcgccacgacgatgtggccatgggccggctccagcgaacgatctacgacagccaggtccccgtcaaagattcccgcaccctgcatgctttccccggtaattttcaccaggtagacatgcggggcgcgaatgttcagcacctcatccaaggagatgtgtgcctcaatgtgatccgctgcaggcgaaggaaacccagccggtacttggaacagacatagaggcagtttccggccgacctctgcaatacggcctaaaattgaatagctcatgacgcacgacttccaacactgtacgaatgtacagttaactttcagaagcgcttgcggtcaatttttgtaggaaatatcagataggcgggcgggcaatgtgcggacgactctcgcagtacagcggcatccacgacttcgttgccgcattgagcatgtccaacgcgctcgtcaaccacatcggggatttgccgctcgaacgctacaatgcagctcccacaacacagcttgcgctctttcaccaggaggaaggatttgtgcatgcagacatggtccgctggggatggcggccccattgggcgaaagatcgtgcagcccccatcaatgctcgggtagagaaagtcgcgcacggcccattctttcgtgccatctggccgcatcgagctatcgtcgcgatcaataactggttcgagtgggtggatgaaggaggacctaaaaagcagccgtacttgattcgccgccgggaccgggcgcccattctgtgtgctgcaattgggcaatatccaagcgccgggcgagaacctaccgagcatgacggcttcgtaatcatcaccgctgacagtgccggtgggatggtggatatccatgaccggcgtccggtagcgctctcacccgagctagcgcgtgaatggctggatccagccacacccaaagagcgcgccgaagaaatagtgcttcaccaaggtgaaccgacagatatatttgaatggttcaaggtggatcgagcgattggcaatgttcgcaaccaaggggctgcgctcatcgctccagtgactccaacggcgggctaacctactctgcgcacgttgactgctagcaacacgatttacaactttcgtgtaaataacagattaactgtttagacgtggcgaatacttgcggagccagtaacaacaagcacttcgctttcccacggccggaaaaagaccacgccttacttacatacttatgtacgtaatttccactttgcgtgtaataaacaggtgtaggaccaactcgaaaaataggtcagatcattcatatacacccattgcccgataccagcttgcgatatacacccattgccctaatccccgaccgccatatacaccctcagccctagcaccatgaaggtgatgcgggtgcatacacattcagccctactacaacttccccgagtggattcgcagcagcagacgtaattaatctcgatcaaccattgacgaataccgcaacaaacatctagtttaaaaacagatcgacctactcctttccgctaccgcgcccataagcgcggcacgtttctttgcgagaataaaaaatgaatgttctgattcttctgatggcaactgtcgagtttcttataaaactcaccgaactgttgcagctgtggggtattggatgccccggattcgcaccctggtgatcagaacagcccacccaacgctgccggctcccaattcatgatcaccaactcgccactgacttcggccgtcccctgtcgctggttggtcgtggtgtagcgaatgtccaaggtctcgaggtggaagccttcgaacacgcggcggatgtctgggtggtcgttgatgctgaccatcactttgcctttgcagcggcgcatgaagtcggccatccgctcgtagttttcgaacggaaagtccacgccatacccggcggtctgccagtaaggcggatccatgtagtggaaggtgtgggcacggtcgtagcgttccgcgcattcaagccaagggagattttcgacgtaggtgccggacaggcgctgccacgcggccgagagattttcctcgatgcgcagcaggttgatggccggtgcggtggtcgccgtgccgaacgtctgaccggagaccttgccagcgaaggcatggtgctgcaggtagaagaatcgagcggcgcgctggatgtcggtgagggtttcggggcgggtcattttctgccattcgaacacctgtcgcgaactgagcgcccatttgaattggcgcacgaactcttcgaggtggttctgcacgacgcggtaaagcgtgaccaggtcgccgttgatgtcgttgaggacttcgaccggcgatggctggggcttcatgaagtacagagcggcgccgccggcaaagacttcgacgtagcattcgtgtggcggaaaaagcgggatgaggcgatcggccaggcggcgtttgccgcccatccaagggatgatgggtgtagacatgaaagcaagacctttactgtatggataaacaggtgctaggctcgccgcgctttgtgcacggagcaagagccttggctggacttgcagggacaatctgcagggacggcggtcgatcctggtgttgacgcacccgggccggccgctcttttttatgggacgttaaatgaatttccgccctaccttgcgaatctccacaggtgacctagcatcaaacggccatcacacaggagactcgaaatgtcgaacggaatatttgcagtagaattcaaaacgaacctgccggacaacggggccggggtcgtcgtgatcaaagatggctcagtcaatggcggggatgacaacttcctctatcaaggccatgtaccaactgcctcaggaaaattcacagagcagtttcaggtctcgaagtggaagaatgggaatacgagcgtcaccgggatcgataattacaccttggaagctaccggggaaatcgactacgagaaaggcacaatcagtctcactgggactgttgttggccattcaaatattcggttagacctaaccggtagaaaactcctcgcagcggtctagtctgctgcatttgagagctgaaggcattcctcacaagcctgtagtcggctctttcctgctctgtgaaacctcccgaacgtaggcttggcatgcagccagcgctatcaatcctcgatcgccgtcatcggtgatgccgacaattcgttgagcatgcgccgggtcaagtggggctcgtacgcttccatgaaccacgccgacggtgctggtggcggttggcactgcacagttgccggtggaagcggtggcgtcgagtaggactgacaagcgcacatcagcagtagcaaggcggtcacgcaggcgactttgatcacgttgggcatcggtcatggctcgaaaatgggtttgatcactggttgccaggcgctgctcaatcgcgatgcgcttgtcgtgttcggcgcgctgcatggtcgctgaggctagcgtgagttcgttgagcgtttcggcgtgcgattgagcttgttgctgcagctgctgaccgtatcgccagtcttgaacctgccacgtcaaagcagcagatccgccggcgacaatggccagtcccgctcccacggccagcaaacgataagacgtggggatcaacatagaaccgccctcgcccgctcccacaactgcaggcgatcctgcaggccattgagcccgccattgatctttcgagtaactgcttcaaattcattgcgatccgccaatgcgttgaggccacgcatccaccagaaccatgccgccgactcagccgcccactgcggcagctccagcagttcaggcgtgcgcagcaatcgctcgtcaccgaacagcgccaagctgcagcgcaggtagttgtcgtggccagtgacctggatcaggccgcgaccgcgatagcgctggccatcaccatccgctgctggcgtgttgcccagtttcgcagccaggctgccggagtcgtatttgctcaggtactggtcgccgcccagttcccggacgtactgcagctgacccgattcgtgaccgacttgcgccaggaacgcggcttggcgtttcggcgtgttgatctgccgatgggccattgctgcgttgagggcggatacaaaaacgcccgcttggcggcgggcgttgggcatgatgcgttgcagctgttgctccgtaattggcatacaaactccagacatgaaaaagccgctcaaggcggcggatgattgagactgatggcgttatgcgaggttgacgattttgaccggcttggccggctttttccctttcttgcccttggcgttggccttgcccttcttgccgccgttacattcaacggtggtcgaccagccggattgggtgtacgtctgctgcaccgactcggcaagaaactcgccatcaagcccaaccttgaagccttgggcgatgatcaggcattccgcaaacagatcagtacgcccttccatttcgaggcgcacgccggcggtggagcggttgaacgccgccaaacgcgcccgtgccgctgcctgggcggcggtcttgttcgggtagatatgccgatcggtatgcaccgccggcagcccggccggggcgtcgtcgttttccagcgacaccacagccagctcaccggtctttttgtcttgatgcttggccccgaccgccttgtgcgaatcgcgatcctcaaagttgaactgccagcggctgacgtcactttttttgatcacgatcggcggcagcaccttaccgcttgcgctctgcccgccctgacgcggcatgaccaacaacttgccgtcggcgaccttcgccgtgcagtcgtattgcttagccaggcgcgtgacaaaattgaagtcggattcattgagctgatcggcccgcgcgaccttcgtgcccaccggacacgccggcgaccagccgttgcgcgcggcgatatcgccaacgatcgccgatagcggcacgtcctcccagctcccgctgcgcacggtcttgccactgccacgcatgtcgctggccttgcccttgatcacaatcgtatccggcgggccagacaccgcgaccccgtcgaccacatagcggcccagccggaccagcgacgtctcctgatagcccagatagatctcgatgcccacgcctttgcgcggcaacgtcaccagcccgtcccgatcgtcaatgcgcagttcgaactcgtcggactccatcccggtcttgtcggtgacactcaattgaatcagccgatcattcaacagggcagtgatgtcggtcccgtcgaccacaatacgaaagcgcggtgtcatgaatatttcccaaaaaaaagccccgcacaggacggggcaagcaaacacagagcgttacgcgtaacgcgaggatccgccggcgaggactccggacggggtcaattccacaaggtaatcgcctcggtcaccggctgcggcagatccggcaacacgatcaccacgccggcgcggtagggctgatcttcatcggccagcccctgattggcatcaagcaccgcctcgacacagccatccagatggccgtaatagttgtgacagatggtatcgagcagatccccatcagacgtcctgcatgtcgtcgccatagcgcacaaactccaaggtaaaggcctgcttgcgcgggataccgccctgcatcagcgcgctttgttcttcatcgacgttttcaaggcaccacgttcccagcacatcgccataaccggtggtcagggtcagcggctgaagctttccgccgatcgcgcgcagggtgtcgagctgctttaacccgccttttagccccggcaggatcacacccttgagggtgattttctcgtcaccaatgcccacgccctgctgcgccggccgccgcgagaggcgctcttgcgaggcccagcggaatttggtcgaccggcgcagctcgtcaaaggccgccgtgtccaggttgaagaaatacggctgcgccttggggtcttgcggctggatgatcagcaggtgcgggaacggcttcaccgcctccggcgccggcgtctgatccgtggcaaaggtgccggtgggcacgatgttggccaatgacgggctgatcttgccggcgatcttgttaatggccgtggcggccttgccggcctgctccttcagcacacccaagcgttcctccacctgggcgaccgcgcgggtggccgtgccgtacatggccactacccgcccgacttgcgcctgcgcggcgttgatcccgcgcatggcccgctgaagcttttccccgatcgccggcccgacaaagggcaggctttccagctcggacgcggcgccggtgatttcgccgatcgcgccattcaccggtgacagcattccgtccaaactgcgccggccggtttcgcctgccgtggccaagtacttcagccccgattgcaactgccccaatgcttccatgtgccccccttatcaaacgtgtggcgtgtcatagagctgattgccccccatctgcttggccatgtcgcgatagtgctgatcgagcattggcttgatctgcgcgaaaagctgattgccatccttcacgtcgccgttgaccaccagcgaaaacggcgcctgaatcgccacgttggactcgacttttggcgccgccggcgccgctgccatcggcatgaccaatgcccccgccgccgcgtctgcgctggccggtggcatcatcatgtctttggcggccatgccgatctgaggcggcggcgtcggctcttccagcccggagcgaatcaccttcggccgacgcagttccgaacccgggaagcgcaccttgttggcaaagtgcggcaacagcatggcgtccttcgaattcaggtcgcgcgggtcatacgacaccggcggcgcctccggaacggccggggccatcgtcgcgccgacatccagccccttgccgggattgatcagcatcagagggccagtggttgtcggcgcgaacgccttggccgtagcacccaacgaggtgtcgcccagcttcggcgccatgtctttgccggcattggccatcatcaacggcccggcatccgggattttcttcagcgcgtcttcagtgccgaacatcgatttgccgacgtacccgcccaaggcatcgccgccgtaactgccaatcaagccaccgatcagccccccgatcgccgtgccgatcaccggcataatcatcgtgccgagggctgcccccgctgctgcaccagagagcgaaccggccaacccaccggcagccgcaccataaccctcggccttttcgtcctgagtttcggcgttcatgtaggtgtcataggccttgaaaccggcatcggccaccgccactacggccgtgcccttcacgacgttgccgaccccgcgcgccatctcgacaccgccaccaacaccctttccaccaacacccttgcgaccgaccttcttgcccttcttgcccttcctgtcttttttatcctcgccgccatccacgtcgccgatgtccagcccgtcacccaggccaccaccggcgcccatgttggtcacgatcaccttttgcggaatgttcggattgcccatcagcgagccacggccgatgttcatcagccccttagccatcttgagagcgctcatcgccgtcgacagaccaatcaagccggcagtggccagaccgatacccgtcaccagtcgcggcgactcgtcggccaacatggccaacttgcccgccacagagccgataccctccgtcacggcatccgtcagcggacgcatggcgtcgccgatcgcgcgcatcgagtcgtcaaggctttgcaccatttccgactgtttttgcgccgacgactgccggcgctcttccaggttcttatccagaatcccggtcgcgctggccgactcctttttcaggctgtcgtacagatccttgttctgcatgtacgcggtcaaggcgcccttgacctgcatatcggcgaacaggtcgccggttcgcaacgccgattccagcgaggcgatcatggccttggctttctcgggatcagattccttgctgatcgcggccgtggccttggccatctcggcggccttcttggggtcggtcgcctcaatgtatttttgggccagtgcaaagctggattccagagtggacttgccattctgcagcccggtgttcatcgagccttgatagtcgatgccggccttctggtacgcctttacggtgtcgcctgagccgattttctccatccagttcttgaggttgttggccgcctcgtccgagccgccggcagtcttcatctgcacttgcagcatcgaccccagttgcgtcaccgagtccatgccggtaatgcccagcttgcccatgcctgcgagcagttccgggaaccagcgcgccatgtcggccgcctcaaagctacccgcctgcccttgataggcgatcgcttccaatgccttttgcatcatcgccgggtcggtgatcttggcgttctgccccaaggcgttgatcatccgcgcggtttcagtaccgtccgaaccctgacccacggcgaacttggccgccgtcggcgcataagccattgccttgtccagctccatgccggcgcccaccagggcgttgaccacctcggccacctgattgcgcgccatgccggtatcgcgtgacgtgtcgatcacggtcttggacagcgtcgcctcttctggcgtgttggcaatgttggccttgatcgcgatgtcacgaatgatcgcgccatagtccgcgctgatcttggccggaatcaccatcgcagccgaggcggcggtggcttgcccgatgctgcttttcatctgctgcttgccggcatcgagctgcgtgtgccccttggccttcagctcggccccgcgcgccgtcctgcccatctgagtgtaagccttgcccagattgcggacttcgacgccttccttcttcagcgcggcgaggttggcttccagcttcttgcgcagggcgtcggcacccttctcgcccgccaaatgcgcctttcgccactcatcgcgcaggcgcatggtgtcgccaatggtcttttcaagaacccgggcgcgcttgccggtttcctccaatttcttgatgcggccggtgacgtccttgaacgccgctcccaccgtggaactgaccgccccgccaatgaccaacccgagcgcaagtttattgctcatgtgcgtgccctaccttgctcagtcgaaagcggctcaatccctgagccaccacagcatccggtcaaagggcatggcctcgatctcggcggcagagaaacccgtctctctcgccaaagtcttggccgccacccgttgggtctcggcgttaaagctcatcctcttcgaccaagcgaaaatagccggcctgcaggcggttgtagttgcgcgtagtcagtgccgcaatctcgtccggcagcgcctgcaacagactgcaaaacatgttgatttcgagctgttcatagtcgcctttcgcgcccgccgaagcagcgcgctgatcgcgcacggtcggggcgcgcatggtcaacttgtcgaccttgatgccgccgaactcggcggcccccttcaggttgatgaccacgccgtcgtcactgacgaccaaccaggaaggatctttcttttccgcgttcacttgagtcattttctaattccttacatgcccagggccgaacgctcggcagccagttggtcaacgccatccaccacaaaaatcatggcgagcgggtcaacctcgaacatcacgcgcccgtcgatttcgagcttgtaataggtgatctttacgccgtgcttgatttcacccacggtcgacggtttccagtcgcccatgtccacctctttcacaccgccgcgcatggtgacgatcacaggcgtcacgcggcctttcagatctgcgaaggcgccacggaacaccagattggcggcggtctggtcagccagaccgaagaacttcagcgcctcgcgacgcacgccgttggtggtaaaagccgactcgattttctccaggcccaccgcgaactcgatcggggcgaacatgccgccgccttggtagtcctcgactttttgggtcagcttgggcagcgtcagcgtcggcacgtcgccggcgaaactgacgccgtcgacaaacaggttcatgttcttcagaacttgaggaatcattgataagcccccttaggcttcaagcacttcggtcagccactcgttagtgacctcgatcatgaaattcgggttttccgccggcggcacgtcggtgaagcggatgcgccaatacactttgccctgctcgatctggctggccgtgttcagctcggtgtccgcgtagacctcaaagttgatgatcgcgccggcgttcttctggtcgcgcatgaaagcttgcaggccttcggtcacgtccttgacgtaggtcttggtgatcgagcggtcgaccgcccacttgtgccccgcctgaatcgcatccatgaggatgtcgcaggtacgcacgcgagtgacgaaggaccacttcggatcgctcgacaacgtgcggttaccccacaggcgataaccgccgtcacgaatgatcgtggcgatattggcgttgttgagcaggttcgcccggcaagtcgcgtcgccgtccaggtactcaactgggcgcgaagtaccggtgatgccgacaaactccttgttcgacggcgaggcccaataaccgtaggtttcgtccgtccaggcgaacaggccggcagtccatgccgaacccggcgcgtcgatcgtcgcactggtgaccgtgtcccagaactgcacacccggatccaccagatacaggcgcttactgccgaagttctcggcgtactcaatcaccgcttcgtcggtcgtgttagggccgtcgataatcgcgatcgcgcgcagcttgccggccaacgcatccatggccgtggcaatcgcttgagtcgccgaatgcttcggggcgatcagcagtttgggttgcgcgttgtgcttgctcttgccatcgagcagcgcttgcaggccggtacgttgacccgaggccagcacgccgccaatgatcgccgaggtttgcagcgcggcgtcttccagcttgggcacaccgatagcgacgattaccgccttggcccgaacatagatcgcctgacaggccttggtgatcgccgagtcagcgccgaaggcggcgatcgcctcgcgctcggtcgtgatcagcatcagctcgccggctttggccgtgccgccgccgagaacgccgggggtgaaggtgtcgcacagaccaatgatcgaggacgacggcagcgagatagtgcgcgcaccggtatcaatcagcgtggtcgtgacgccgtgaaaaaaaccactcataagggtcaatctccagaaacgaaaaagccccgcataagcgaggctgtgagggtgttcgtgttacgcgtaacggaaaagaaaacgccccgtcagtgcggggcgtctattgcagctcggcaggatctggcggcgaggaatccggccagccctgcgacagcatgtcgtcgtgaaactcaccggcctcgatcgcgcgcaacagcgtcagctcacggtcaaaacaggcttggacgtgcgcccgcaccgccttggcaatggcgatgatctgagctgagccgatctcgacaaagcccgtcaccgtcttgaagttacagcgatattcgggatcgaggacggcggacaatccagtactggcaatcagcgcctggctgtcacgcgtcgtctcgatttgcaggccatcgacggtgacgccagtggcctcacgcttgtagcgctcgacagcgactaactgcgcataatccggcaccggcgccgggcgctcgcccttgaccacctccccgtcgaccagacgccaaatgccgtcagtctcctgagtgatccgaagaaaaaggccgtcatcgaccctgatcgccgaagtggggatctgatgaaccccgctaatcagacacgtccgcaacgtcaaatcttcgttaaatactgcgtacttcatggctcacctcagtaaccgatgcagatccaggagaaggcatcaggataagtcgcagcagcgttgcggtacttaaaccccgtggccaccaagtagttattgtgaaaggacagagtcgcctcgttttgcccaaacaccagcgcacacggaacattcggaaactggattggaaaggacaccaaagtgtcagccgcgttgacggtgttattgccccactggatgatcaagccgccgagccacgacgggaacacaatgtagccattaatggccttctggatttgaaacccccagcgcatttttttcggggtcacgatcgtggcgtcatcggtgcccgcgtcggcctgcgtttgcgtggcgatcttggccgtgccgagcttgatttcggtggcctgcgttgccaaagtctcaagcgcggcaatgtcgatgtttccctgattgatcggcgcgttccaggccttgatgcaccacatcacggccaagttgcgtgggcgcacagttcgccaatatgccgtgccaaacgaaccggattgcatccctgtcgaggtgtagttgatatccgccgcgaagcccggcgcaggatcagcatcaatctgcgagacgttggcaattccttgaatcgtggggccaacaccgtcgtcaccttgaatcttagtgccgacttgatagctgccaaccgcacgtccagcatcaaccccgcgcccatgatcccagccccgcaggaactccgcgcgggattccggcaagcggaaattacccgcaccttcgtctcccttgttgaaagccgtgccgagaaacgtcgccagatcgggatagaccgcaatgcttttaacactgccgtccagctccataaacccgggcgcgatcttgtccagcggaaacgccaccatggcacccactggcaacgccgaggcctgagcaatcatcgcctcgatctcggtcttggtgtaagtgtccttgatgcccatgccggcgagcgtttccgggttatcacccgatacgaaaacaccacgatcgttgaccttgacgcgcgtgtattgacccggcgtcttgttcttcggcagcacttccagaatgaccgcgtcgacgtaggcccgcgaggccagcacgatcgccgggtcaatcttgagctgaatgttgccggtactggtgacgatgaaattcatgcgcacgatttgcgtgcggcccgaaccctgcgacagcaacggcttgaagctcggcgcgcagttggccaccgccaccagatccccgtctgcgtcgtacagaccgatttcgcgaatccacttaccgccttcatcggcgggaatgatctgctcggcgatgaccaccgccgggttgacgggatcgattttcagttgattgagcggcttgcggcgccactcattgagcaatttggcttgtccggccgccggtaccgggttgggcggatctgccagcccgttcgggttggcatcacccacgcccatttgcgtgatcagccagggaatgccgagtgcgtcggcgttcgcctgcttggccatccccacgttcgtgaggatcgcgaaaaactgcgaattcgcatcaatcataataaacgtccagggtgtctatggtgtgttcgcgaccgaccacgccgaagctgccggtgacctcgatgtcacgcatgacgggcgggtaaacgtcgatttcgtcgccttcgtaaagggacacggcaatattcaaatcgccttgtgtttccaggctgatcgccagcccggtcagatgtcgcgtgacgggcttggcgtcgtcaatcaggcgctctagctcctgatacatttcctcggtgatgccggtatcaagaacgccgaccttcagcgcgaaggtgcccggcacgccctcgggcacggtgttgaaccactcgacaatctcgatcagatagcccagcggctcgaccacccggcgcagcgcgccgatcgtgcccttgtgcttgtggatgtagaaagaggccttgatggccgcgcgcttggtagcctcagaccatcggtaatcccagcgatcgacagaccacgcccacgccagatgcggcaacagctgagccgggcaagtgtcggggtcgtacagcgtgcgcagcgggacaatcgtgcgctcgtagaaagccgcctcgattgcccgctccagtggcgtgctattgctcggcagaaggcttttcatgcttcccccgccagcttcaccgtgtaacccgtgcagaacgccgcctgcgccttcgtgggagccagatcgacccatccggtcagttcaacccgcgagacgccggcaatgtgcaactgcgcatccaccgccgaccgggccacctcaacccccagccgcttgcgtggattgatccatgccgccagtcgtcgctcggcttccgcccggctggcctcgccctcaggccccgcactgctcatgtgcaaaatggcatcaatgctgtagtcgaggatttccgcgctttgcaccttgacccgatcgccgagcggccgaacgtcttcgtcattcactgccagccgcaccacgtccagcaactcgtcgctggcctcgccttttccctcagtgctaagcaccgttaccgtaacgttgcacggtgatggactttcggccgaggcgtcagccaccagccccgaggcgttgcgtgtgtgcaggatgtagctgttacgcggcccggccgtggtcaacccctcataagccaactggatgcgctcgcggtacgggtcgtcttcctccagcacttcaggcaccggcggcgtgacggtcagatcctcggcttgaatcaccaggcgcggcagattgacattggccccaaggtggtcaaggtcactcttgatcgcgtaggccaacagcagcgccttggacgcgtcgttgacccgggcgcggttgcccagcttgatataggcccccgtctccagcagcttgaccaccggatcggattccatgttggccgtccagttgtcgcccaggtcgacccgaaaggtgctgaggcaatcttgaaaggtcagctcataatccagcggttccagcacgtccggcgccggcagtgcggacagatccaagacactcatgtactcacctcggccacgaagtcgttgcccaggtacttgccggcaacaacaaaatcaatctttccgcccagcaccgatttcacacggacgctcccaagctgcacgcgcggttcccaccgctcgatcgcgcgtgcggcctcggcttgaaccgagcttttccacccggcgttaaccggcaagtccacgtaactacgcaccttgctgccatattcaggacgcacccggcggctgccgatcggcgtgctgaggatgtcgccgatggactgaatgacgctcggcaaatcggcaatgggctggccggtgtggcgatccattccgatcatttacgtcactccgggggttcaatttcgggatgggatttcaggtaggtgaccgcttgttcatcggacgccgagacctcgacagtggccttgaccaccgacagcgttcgattcgttccagggatgcacaaggtgcgcgaggtgaagaccgtatcgcggaacttcaacagtagatccggcgtttgaagttgagctggcacgggttggcgaatcggtgacggcagttgctcatcgatcgcttgctcattgttcttggccatgggattcctccgggcataaaaaagcccgcacggggcgggctggatgggtgattaatgcttgtggtgattgtcgctactgccgacggccatgatgttcgcgtcgccgtcgatgttaccggtgacgtgtaacgtaccgtcgatattgaccggccccttgatgttcaaagcgccctcaagatcgatcgttctcgacttcactgtcaccgcgttatccgtaacgacgagttctgtactgccgactttgatcgtcaccgtgccggtcggcagggtgatggtgtagctcttggcctgccagtcgtagaccaccgaaccgccatcatcaaaacgccagacctcaacgtggtcgcggttgtccggttgggcgccggcattgccgtacagccccggaatgaaagtgcccatgccggcctggccactggggttgaacagcaccccctgctcaccaggactcggcgcgcgccagtgccgcgccttgccggcggcaaggctgtgccagcgcacccaagcacttgtccattcgccactcgacacccgcacagttcctgccggtagatccacccccaccactacgcaaggcatcagcatggccgcgatcatgcggtcatgctctgcactggcgtaactcatggcgagtcttccggcgccaacacaacttccaccggaaagccgccgttctcgggaaccacttcgggatcatctgaccaaggccattcctctgcccccaaatacagcttatgggtccattcaacgacccatacggtgtagccatccaactccggcttggtccagtcctgcatggcctgaacgaactcggcaggctcgaccgcaacgccccaggtttgcaggcgcaacagcaccgccagttgggcggccaagtgtgcggcctgctgacaatgctgcgcacgaatcgggtcgacgatgatccgcgcttcgaacctgcagatcagcgaggtctgcccggtaccgatgtcagcaccgggttccatttctgccatttcgatgaacactgcaggcagcgcaatgcgatccttgatgttgggccatgccgtgactgctttgacacctggcagatggctcgatacctgctgttcgatcgcctgataaagctcatccagcgtgaatggttcgtcagacattggccgtccccttcaggtacttttgaaactcaaagttcagctcctgctgcaggatctccagcaaacggccatgggcgcgcttgacccactcgtcgaagtgcggacgggctccctcaagcgaaactttggcctttgccagtggaaagcgactgccgttctccgcgacccatccagaactggcaccgcccctcgccgacgctgtcgtatcggggtagtcgttcgaattgaagtgcttgcttgcggtacggatccagatatcgggcttgttgccgtagacctgtttgaggaaagcgccttgataacggcgccccgccactgatacgccgctgccgttttgccgtgcgcgaccgatccggctggactcaatggcattcagtccaaaccacaatttaccgcttgcggctctgccggcgaccgggtagctgcgcaagcgctgacgcaccgctgctacggcgatgcgctcctgccggcccaccgcacgcgcaatgtgagtgcgcagccaccctaacgttttgttgatggctcgacgctgagcagcagcggcagctttcggcaccaatgcagcgaaaccttcaaaggcttgcaaatctgccgccgaagactgaattgtcagcatcccgccactggccgaggatttgtaataactgccgacgctcatgctcgcatcctcaagatcaaagcgaccaaaccgtctccgctcggctcgagctgaatcaggtcgtagtcaccaccgccgtccaaggcaggcaagtcgacgctaaccagcatgccctgttccagaccatgggaatcactgacgcggatctcgaagcgcggctcgcgcaatccggtgttgagcttgccgaacttgggttgcagccagggcgcggcaaacataccgagcactggttctttgcgcccctcaatccacgcggtatcgcccagcgtttcgaacaccaccgcgtcgacctcggcgatcaggtcgcgaaagcccacggtcagagttccagcaagacttgggcgcgcggtcgcgtgcaaagatgcagcgggttcgactgcgcctcaccggccatgcctttgttgaagggcagcggctcaatcatgctgtagtacggaatgccctgagtgttgaccgtttccatgtagtcggccggcgcaaacaccgagatgtacaaatctggcacgccttcagggatcagaagtgccttatcgtcatgcacgaacgacacgccggccaccttgccacggtagcgctcccaaataatgccgccgaactcgaagctttcccgggcatcaccccgcagcgcggccgcttgctgactgttgaggtaggtttcttttaccgaggggtggacgatgaacttgttccaaaagtttttaccgcagaaggcgcgcgagccagtactggtcacgctacccaatgcatcctcctgcatatccagcgcctcgccgcattgaacccgcaattcagtctctggatccgccagtcccatggacatcttttgccgcttcacaccgaagcggtcatagagatccagcagtacggttttgccatcggcgtcgaggatctggccattcaatgcgcccatgcgctggaattcgtgcgtggcgtccaactggcgccgcgccttggccagccgcgcattgaccacgtcttgcaccgcctgcaactcagtgcgagtaccgaaggcgcggataccctgaatctcatcggctttgatggtgaagcgttccggcaggtgcacggtgttgaacgggataaggctgcgcttgctggccgcgaccaccaggccggacgtaccgcgctcaccggccggcaccagtgccagggtgtcgccgtccttctcgatctgcacggtcagggtggtaatgccttcctcgcgaaacaaacccagtgcgctgatgcgccctggcaggtacggttgatcattgagtgcagcggtcagcgaatcgacgctgaatgcttcgtcgtcaaaaatggcgatatcggccatgggtactctccagaaacgaaaaatcccgcacgcggcgggatgcatataaaaaaaggatcgacttagcgaacgatcacgaaatgagtggcgagtgctttctcggcggccagatccaggccggtcaggtgtgcttcgctgacttcggccaaccgcaccacggcgcgaccgcgacgcaccacatcggattcgccaagcgggccatagagaatggcgacagcgttttcggtgccgtcctcagcagtcggttcgtagggcgcgaattcgccggaggcggttaccagcccgaggatttgtccgggccacaacgctgtaccggccgcgacgttgatcgcttcacgcgaaatattgcccgcgccttcggacagcaggaattcacctgcgtgcatcggttcctgtttgatggtcatgctcgtgctcctttcgcgctttgcgcggttccagtttgggccgcttggcgagcggcccaaatcgagttggggtcaggttgtttggccagcaccttgggcgccaggtcgtccgccagcggcagactgttgtcgatttcaaagcccttaccgctggtgacaatcttgtcgaacagacgcgcccgcaccgccggcgcatccagacctgcagcgacatactcggcgctgaattcaggcagtcgcgcggccacgcagaggtcgttaatcgccttggcgcgtgcaagacccgccaaaacgatctcttcactttcaagctgggtggacttgagcagcggctcgatcaggttgctgatgcccgccgccgtgcagcgctgagtgaccatcaatgccaacttggtcgagtcgactacaggcggaaccagcggaggatcgacaggctcaagatccggatccgcctcaggtggctcgtcgagctgggccagcaaatcagccggtgcgttctggaatcgttgcagcgccgcgccttgaccgagacaagctttgactttgacgccgtcgcccacttcatcagccagtcccaaggccaccgcttcgttggcggtcagccaggtttcagccgccaccaaacgccgcagctccacctcatcaatgtcgggcgccttggccttgtacgcggcgatgatcgcttccatggtctggtcgagaacgtcggccaccttgcggaagtcctccgcatcaccggcggcgtaagtccatgggttatggatcatcaacatcgcgttggaagcgatgaccacgcggtgggcaccgcacacagccacactggcggcactcgctgccagtgcatcgatccggccggtgcagcgctcgcccagccgcgacagcgcgttgtgcatggccagaccgtcgaacaggtcaccgccgatactgttgaacgcggcgaccaccggcgacacaccatcatccatggcgcgcagatcctgcacgaactgattggcagtgataccccacgcgccgatctcgccatagacgaagacttcgatcactcgctcggcggcctcgccgctggcatgaacggcgtaccaggtcttgtccttgacctcgacgcgtttgccggcgcggttgtaaatacgcggtttcgcgctcttgctcatggttgctccttgtcgtcggtgtcttcgacggcatccagggtgttgtagttgaggcccagcgctgtggcccgcgccagatcggcggcgttttccaaatcgaccgtttcggcgtcgtagccggtgcgcaagaccatctcgctgcgcgacgcaaacccggcttgcacttccatccggcgtgcctgcacgtcctgcaccggctggatgtaagcccagccctgcggtacccagcgggtccgtaaatactcgcggcgcttttgtgcgtaatcgtccagcaccagaacgccagacagcaccgccatgtccaaccacgccgcccgtacaggacgacagagttggtgcacgtacacgctaaattgcagttgctccagacgccgccgaaactcgttaagcaccacccgaagcgctcggtcgttgattccgcgcatgtcgccggtgaggatttcgtaaggcgtacccgaccccgctgcagcagccatcagttgctgtcgcataaagtccgggtagttgttgccggcgtctggcggtttggagaactcaacctcctcacctgcccccagctcctgcatggtgccgggttcgagcgcgaccatcggggtgaacccgtcacgatccaaatccagcaacgcgccggtaactggatcgcgtggagccggacccgagtccggcgccgggcgcttgatgaagccggcgaacaggttggccacttcttggcggaacagtactgcgtcgtcgtagttgtcgaggctgcgcaggcgttttagcaccggcgacaatctcggcactccgcgcaactggccaggctcaaccggttcgaagatgtgcagcacctgggtagcaggcacgcgaaccaactggttgtagccagcgttcagggaggctgcatcgcgcggatgcgacaggtacatccagtacgcgacccgcttcccgcctggggtgaactcgatgccagcgcggatgacgttgccgtttttggtggtctcgaacttgtcgtgcggcacaaattccggtgcgaggatctggagctgcagcggaactgctaagccttcatccagaccgcgtggccgcaagcgaacaaagcattcgcccgaggtttccaccgtacgcgccaccagcgcctgctggccgtagaagtcggtgcggtcatctgcatctgactcatcgacccaatctccccacagctcctggagcagtttgcgcaaggcatcatcatccgtcgttggcctaggcgtgatgccggtgccgatcaggttgctgacgcgcttgtcgatgacgttgaaggcgtaagggtcgttgcgaaccgccgcccgcgaacgcgaccgcagattgcgcagggccggagtgttgatgctgttgatcccgttgtcgggagcgtcccagccagcggagcggcgcccttctccagcgccttcgtaactggccttgatgttggacggcagcacgaatccgttacgggtcagcgttgggaagtgtcgagccatcagacccccttccctgcatggtacagccggaccacgcgcgaacgtggcccagctgcacttgccaacgacgatcgtatttcctcgcgcgccttgagcagttcatcgaccgtgcggtactccacggtacggtcggtgtagcgcacagttttctcaccgcgagcaatggctgcctcaaccgcgtcgaggtgcttttttgtaaaggacatatcagcgtctcttcagatagccgctggcagagctgcggcgttgagggggtgcggctaccggtcgcggcgttgcgaccggtgcagcgggttgcggtgcgggtacgagttccgctttcgcattgctagatgactgctgcaatgcgatagcaatacgttcgctttgaacgggttttatagctgcggtgtcatcaaacaaaccggcctgtgccagtgactgtcgaacccgctcccaatcgtgttcctgataccggttgatacccaagtaatgggccatggccaggcagtacaccatcaggtcgagcgcttcgttgcgctccgccttgcccttgacccactcgatacgcttgtgaccgcgcacgtaacgggcgaccttacgttcggccacgcattgagcgaagaactcatccggcaggtcgttggcaaagtgcagcgatcccggcccatccgggaacgggtagcggttgtagatccagtctttggcggtgtcggtaccgacgaaccacagctcggcgccgttgcgttcggtctggcccttccaggtcacgtcgaccatggacgggcgctgagcgatcaccggcctacccggcttgctcgcacccttgatggcgaagacgttacgccaacgacgggcgcggcagaactggtaaacctcgtcggtgtgatgaccgccggagtcgacaccagtggcgagaatccccaagccgacaccgcagggatgccggtaccgcgccttgagtttttcgtccagcactgcccaggtgcgctcatccgccgggtcgccccatatgatctggtgatccaccacccagcgctccatgccgacgccgaagcccatcaccatcagttcaaggcggttggcctgaacgtcgacggcgccggtcagcatcagcacgcccagcggcatagcgccgagggtgtatttttccaaacgcgcccgagcgatcaacacttccgccttggtctgttcgagcgcgctgtcccataccttggccagtcgggtgttgtagaacacttgcatgagactagtatcgccttgcgcctgggcttttttcgcgtcctcgaactcgacggcgagcgaggcccaatccatccagccggtcggcgaatacagcgcactgagatgaaacccgacggtcttaccatcgccacgaccatgcgcacgccattcacctcgggcgagcatgtcgcttttgtggtgctcctcgatcagcacgtcgcactcaggggcggcgcactcgtaatgcacggtggcgtagtccgcgctgtagtgcagccgttcccactccagtacctgcatatgaccgcacgtaggacatggcacgtagtagtgacgctggtcgctggattcgaacaaatctgcgatacgcgaagcgcctttgattgtcggcgagctggaaaaatagatcttggcgttgcgaccgaagttggttgcccgagtttcggcgagccggatgggatcaccctcctggccaacatcgttctcccagcgatcgacttcgtcgccgtagatgtaacgtgccgacagctccgaaaggttggccgcagaacctgcagttgtgacgtacagcgaaccaccttcgaattccttggtgtcaatcgtattgcgcgcgtcccgtgagcggctcgttgccacgcgctcgcgtaacaccggggtggccttgatggtcttgctgatccgccccgaaacccgcttggacaatccaagactaggcagcaaggccaagatgttcgacggtgccatgtggatcagtccgcccatccagttgagagcgatctgggttttcatcaactgcgaggccaccatggtgaccacgcgcctgcaggggtgagccggcgacaggcagcgcatcggctctcgggcataaggtgtgcgtgaggtgcggtactggcctggctcaggtgcgccggtgtctcgcgggattcgcatgtactcatcggcccattcatcaatccagagatcggggtcagggcgcagtccacggaagtagttctcacggtacacctttgcaccgtcagaaaattccgtgtgcatgggttcaatccgctgtcatggcatgttcaagatccgctgaagagaggcgctctgcttcttccagcgtccgacggatcgttgccgtcaggtgtttttcgatttgccaaggatccgtcatcgccgccaagtcataggacagctgcggaagcggcccaaacaactggtcgcgcaacaatctgcctgcgtcgtaggcaccggtctcgactgcctcccgggacaccaacgaaccctgcgccttgcccagctcgatttcggctagtttggccatgttgtgctcgcgcagtgcgcgggaccgctggtagtcagggtgcttgccgtccacgggtatcagttgcggcggcgcagccgtggaggtcggctcgctgacgtgggacaattgactgtaaacgtcacgctgaatccgatcttgctggtgacgttcggcaacggcgaccttgctgggatcgctggttttatcgagcagcgcctcggtggcttcaaggtcgattttgccgttctcggtaagcaccagccgatcctgactggccaattttgagacataggatttggcccaaccgcgccgggccgcaaactccgttttgctgatgattgtcatggttaattctccagttcaccccgcgagttcacctgttcacctcagttcactaagctggtgaactgtccgctaacacagtcccgcgggtttccgaccccgtgcccctcagatgcctctagggtccccggcggttttcggcgcaccagatcgatgcatcacccctactcgcccccggatggcgggacttcgcagacgcccagccgcttggcagcccatcgttcgtacaacccgatggctacatccgcaccggccatcgccgtgaggcaccccaaggcgcccgccgtccagatcgtcatgccggcggcgatcattaacatcatcgccgacaccccgcagacaatgcaggcgccagaccgaagtgccagccggcgcaacaatgcccagccgcgcgcgccatccttgtcggctcgccacatctctcccgatacgccgccgaccagggccaggacgattactaaccagatcggcatctctgccagtgcttgctgctcgtttgtcatcgccatcccctaaaaaacaaaacccgacgcaatggtcgggtttgatgtgtacgtgtcgctatgccgtattaccaacgggaaagaaaacccccgccgaagcgaggtttagttaagtgtttctttcaagtctttcggattgggccaataaccggtcatcaatccccccttacaatctgatcgaggcaagggatacctcgatacctttgagcgatttcctctgcctcatcaagcgtaagcggggtcgactgatgaatacctattgcttccgcactgtattgcttttcaccactcataaaaccctcagctggcaagcgtgcctgccgctctctgcggtcgcacctatcgaagatgactactttttacaggtcgattccggtggcagcaaccctgttttaatgccacccggtgaataagtgggtaacgcagggtgaacgcctagcgaatgtcggcaaatacatcaccacggcattctgttgctgcggtggtgtcccatacgtcccactttccaaaatcgaagtgggacgcctgagagcgcctaaattcggagcttcgccccactgtcctacttatccttctcctttctcgtgtaaaggaagaaatttaaagaacacgcgttcgcgcgtaagcgcgtactgcttttccgctacgctcacacgggcgggaggcactactaggcgggacggtgggacaacccaacaacgacaaggcccgcacctgtcccactgcatcaaaacgcagcgagacaagacgggccagtgggacaaccacaaccggaacgatgcctggggtcacgcagccagccccatcatcacgccgaagatctgcagatgcgcctcatgcaaacgctggtagtacgtgtcgcggccacatccgcagtgggcataccgcaagcgcatatccacatcgagcgtgcagtaatgctcacgcaccaccgtcaccagctctggcgcgaggtgctttgtcacgatcagctcaatatccaacgaactctccagcggcgcacggaaagcacgcctccccctgatcagttgcccgttgctctccatcatcatggcaaccatatttccccctgccagccctcctttcgaatgttctgaatgcagctcctgcgcccacaaccgaagcagcgaatcgatctccttaatcaaaacaaggctcctcgaacgcttcacgctgcaatgccgatgcaccgccccaccctgccggcttcttgtaagcccaaggccgctgtccactcttcaccaatgcaggcaaccgcacgcgccgccaacctagccgatgcatgatcgccccgactcgcatctgctccggcttaccccaatgcccgaggtccaacttcagcgcactgagcagcacatcactgccggtggcggtctcgccgatctgcgactcttccagccaggtcagaatcggcccttcccattcatccacaacaaagcgctcgtcctgctcttcgccgaacatcgcagcctcatccagcgtcacccaccaaagatcgcccgcgtcgtaacagaacaccgcctcggcccacagctgatcgcgcatcgagcgcaacaactccagatccaccttggtacacgcgaccggccagtaacgccggttgccggtggcgtccttcaggtactcgtcttggttggtcgtacccacgaaaacacactggcgtggcacgtccatcgttctacggccgtagctctcgcgataagtgtcagtagacgcagaaaagaactgcttggccttcgtactctcagccttgttgaagctgtccagctcgcccagctcaacgatccacttgccccggatcgcctgaaagccgtccttgtcgcccagcgcaaacggtgtgtccatgaaccactcgccgccgagaatgctcatcgcggtcgatttaccagcaccctgcgcaccttcgagaatcatcaccgagtcagccttgcagccgggcttcatcacccgcgctacagccgatagcatccagcgcttaccgacctttgccgaataatctgttgccttcacgcccatgacttcggtaagccaactttcgagccgaggcacctgatcccactgcagcttgcgcaggtactggcgcactggatgaaacgcatggtcatgcgcgaccacactcaccgcctcgatcacatgcgaggccttgacccgcaagttgtactgctgcgcgagccacttcatcacccgcacatcatcaatgtccgcccaatcgcccgtgccgccgccatagggcgccgcacgcagcttgacgatcttcgaactgaatgcgctgtaactaatgaccccggcccaacgctcatcgttggccaggatcaactcgacgttctgcatgtgcgcaatcagcgcgccgctttcgctgcgtgccagcagatccttccaaccaccagcggccgggggcttgaccaccgccaacacctgacggcgcaccgcctccaaaccctcagccacatgcagatcattgaagtcggtccacttggcttcccgctcgctggaaaagatcggcgcaaccacctggccaccgacaattagcgccgcgttgtttgctttctcttcaccagggttccacgcatcgccattaggcttggttgtcttccagtcatcgtctcggcagatgatcagcgggcaaccggcgaaacgctcgcgcatcgccttgcaaaccaccagcaaatttcccgcatcaaacgcaacggccacggtcaatgacgtggccatatgcagacttgcgccggtcgcgtatccctcacataccagcaccggctcgcccggatccgggtgcggcccgatcagatggaaagcgccctctttcgacatgccataaggccaataggacttgtcgcgaccggtgtcctcttgcttggtcgggaacaccacctgcaggccgacaatctcgtcgcgcacattgctcatcggcaccagaaaagcaccggagcgcggcgcataccgaacgccgaagccaacaatttgcttgcgatccaggtagtcgctacggcccttctctggcatgcgtttgaacatacccgctgcacgcttcgccgcacgacgtgccgcgttggccgagatctcagctgcccggcgcttggcctcttcctgtcgagcgcgcataacttcgcgttcttcaggcgacatccgcccagccttgaccttgatcttctgagactcgcccgaacgccagtcaccgaacgcaccgaagatcagcgtctcgcctttctcggttcgctgctcatgaacgacataccagccgttcttttccttgcccttgtcttgcgtcgttttgcagcgtgtcagcttgccgaacaccaaaggctgcgcaggctcaaggccataatcagcgaattgccccagcacctcatcgagcatgtcgagcctccatcatttcctcaatggcaaggcatcctacgcactgcgtacagccgggctgcgccaaacggcgagcctccgggatagggtcatcgcacgtttcgcaaaagagaaacgaatgcgccgccaaagcaggcttggcggcgagaagacgtgcagccagcgcttgatcaacgcgctcctgcaccaggtcatttgcaaagtcagcgatgtcagccacgatccacaccccgcgttgtctgattgacgtacgtggcgcggttgaacaaccccagcaacccctgaataccgcggaacacctgcaggcggatcgcagccagttcctcatcggaaacaaccccatcaccaatgctcttggcccaggtatccgccaaatccgccacctgccggaagtactcggcaatcccggtggtcaacgtctccggcatgtcattggtgtatgcctcagccagctcctgccaagtagtgtcaccgaccaacgcatgcaccgcatccagtatgcggcgatccttggtcagctccagaatctcgccgaactcttgaatgttcacagtgtggctggggtgggttggggacagcttgtgctgcagcgtggtcgcattgcggccggtggtggcggcgatggcggcggcgccaccggggtagtcccgggcagcatggtaaagcgcgagatcgagcggcaaaacttcccgctgcgcccgctcaacagaactcagagcgatacggctcatggcattaatccttgtaagttgccagtgccgcgcgacatgcagtggtgatacatttgccgcgtggcttgaaagggcccaaacgccggctagatcttagggatcgataccggcaccgtgccggggcgagcaatccgttgctcacccctggcgcaacagctgccaaatctgtggtggaagaggcagcaacaccaaggcttccgagccttggaaaagcgcgataaagagaggtggttgcatgtggtgtgcccgcctatctttatcgcgacccgacagcgctgtggtggtgcgtgccgggaggaacttggcgacctttgggtcgccttttttctgactacgcagcagatttttgcggagccgaagcgttcaaaagccaagtcgcttggaacgcgttgcctttctgcttcgcagcagccgccaacagttcggcgtattgggtttcacctgtgtaatccgttcgcggcaggcaagcagcctgacgccatttgttcagtgcttggtagcttctattgcataccttcgcagcggccccgatgccgccaacggcttcaaacgcaaacgcaatcgcgttcggaaaatctgcggggtccaacatgacaacctccatttatcaacccagagttgatattaaacatcaactgactattgcgcaagctccatggcactctcaacccatggttgataaaaatacactccgcgccgcttttagctcgcgccttcacgaagctctcgacaacgccggtgtacgaagccggggccgaggggtcgatattcatcgtaaattgaaaagtttgggggtcgacaagacaactcaagctgtcagtaagtggctcaacggcgaagccatcgccgaagcagacagtatggttgcgctttgctcttggctgaaggtacgccgggagtggcttgaatacggcgtactgccgaaggagcagaccggcgaaagcaatgtgcttcagctggtcgtcaatgatgagagtaacgttagtgaaattaatcagcgctttggcaaggtgcccttgatctcttgggttcaggccggggcctggtgtgaggctatttcaaattttgagtcatacgaggccgactcttggctctcttgccctgtaccgatcagcagccacggatacgccttgaaagttcttggtgactcaatgacgaatcctggacctggccgaagctaccctacaggatgtatcatttttgttgacccagaatccgagacaaagactggagaccgagtgatcgctagggtcccacggaccaatgaagcgacattcaaagttttggttgaagacgcaggacgtcagtttttgaagcctataaatccacaatatccaataatagaaattacggaagaaacccacatatgtggcaaagtagttggctctttcatccctgaataaagaaccaactactgtatttatagttcttcaactgttttagattgccactcgggggcatgcagtagcacggctactttatctttcacgccccataaaggagcagtgtatccccaataaaaaaagtgagcttttcgctcttcactcaactctctactagtgtttttccctgccttggaataaaccacaaccaagtcaccagccgtcaacttcttagaagccagccatagcgtattgaaaaccttcgtagtgggagaaccatccgccccatatccggtcctcagaacaacataatcagcaatattggtatcttttaaaactttaattaccaatcgttctttttccaaatcacccttatcagcaattgattgtagtttcagattcatagcttcaccgctttggcaccaatgccagaccctacgagtaacaccccaaaagacagaaacaaaaatggtgtcacaccacctgctgcccaaacgttaggggcatagccaatcgccgctgctcctacggtaatgcaacctaacgataaaacctcctgagctaaattggatttaattttctcattcaataccgcgagcgacttatctacccgatgaaattcatctctaaaattcgcaagctccgttttatcatcctccagtctatcgagatcatctaaaaccagcttcaacacagcaggcgatgagtattctttctcgctcaactcacgcctagcactggtaaacgacttccgttgtcctcgtttttttgcttgaaccggttgagccttaggtggcgcactaccagtagcattttgatctgcagtaacagagtccgaagtttccggctccgtaggtgcttgctcaaccggcgcgtcttcaacgggctcagttagttcaccggaacttgtagataccaaattaacactccatcatcgtagtaaagcgtccctgaaaatttaaaaaaccgccaaatgttaaactacactttttttaaaagttcatcaagacatcccacataatcctaagcgcgaaaattaatacgacgattaaacattaggagcgcgatattcgaataagagatgaaagttcctacctaaaaaaagattttaatcaactaatggttgttgacataaatcaaccattggttgatatttgtctcactcttccaccacagagcgaggcaaaacaatgcacaccacagcaaccctgcacgtccacccggccgctgctgacccttcccgtatctttgagatccgccgcttagcacgtgaaagcggctgctcgtttgtcaccagcaaaccgaagcagcaagctcgcaccactcccgccccatacgacccgaacggcggagggcacgcagcatgatcaagttcaaaatcgacaaccgcaccctgcagttgctcaacgcccaggtcaacctgactgagaccttcaaccacgtactccggacatcgcccaagcgcgagtgcctggcgtttcgcctcaaggttgagcgcggcacaacagaaagctcgttcgtcgtcgagctaagcaacgaacgccacacgctgaccctgccgaacgacaagaagatgcacctcaagctggccgacttcatcgaagagatcgccaatggcccgttcgacgcaagcaacaccagcgatctggtgcaccgcccacacgcaagccgtgagttcggtcgctttgaggtctcggacaagcaacgagtgttcgagctgatacgcactggcggcgtactcaacctcgatatgggtttcgactacccgctaatcgtcgcgcttcatcgcgctcattctcgatcaggtgtcaccaccatcctgagcatcggcaacaaaagcccgcacacccgttgcttcaccatgtacggcagcgatgtcgagatctacggcaaagtcagcgagtccatcaaccaccttgctgcagcggcaacaccagctgcgcacgcggcatgaggggcacaccatggaacgcaccctcgcccaagccgcaacccacctcggcctaactcgcccgaagctcatcgcacgcatgcgggaaaaaggcctgctcaacgaacggaacctaccggcctaccccaaccgtgaccgcgattacctgcggatcaaggacggccagtggtaccacgaccagctcggcatgcagtacagccaatcgaccaaggtgaaacaaccaggcatccgctggctagcggaacagttgggtatcgatctgcctgcaatcccggcagacagccgtgacgtggcctagggaatacgcccgccagatcatcgcaatgcggacacgagaggagcgcaacgccgcgctcctcgaagtgcccgaacatctgcgcgagctgaccagaacacattgcctgaacgcctggaaccacccggccagaaaacaacgcaaggaggctcaacaaagccatgagtaacacagcacaaaacccgctgcgcctgcatccggcgccggagtcagccaccgtcgaattgctttaccgcatcttcggcgacgtcctgatcccgctcgacaaagtccgcgagcagtactttcgcaacctcaacgagcagtcgttcgtggccgagataagcagcggccgcatccagctccccatcacaacgctggacaccagccgcaaggcaccgaagtacgcacacatccggcacgtcgcttccctgatagacatccgcgcctacaaggccgacgaagacatgcagcggcagcaggacgacgcaaacgagtaaccgccacaaaccgaatggctgccaccaccagccgaagacatcaccaggagcacaccacatgactgcaatacagatctgcgcactcatcgttctgatcacgctggccgggctattattctgggctggctacttcatggggcatagcgacggcaggtccgccggcgcgaaagaaagcgacgatatccagcgcgccgaaagcgccaagacggttcgcgaattaagggcatctctcgacttcatcaaagccgaccacacccggttgtcgcaacactgcaaacgtctgcagatagcgatggcattcggaggccccgagcgcttagcacttctggaaatcgccgagaaacttcgcattgccgccgacacattcagtgcattccgcgcaggcaaaaaattggagcgcgacactcgcgcgctgctcgaccgagctgtcgacatggctgagcaactggctccctttgatataggagacgccgcatgaacgagatccttacccactccaatacccaccgcgacacggcatacgcctcaccagcggcggacgaaccaacgcgcaatcgaacctcagaggaaagcggcatgcaaaaggatcagcacaacacccaatccacgaccgctttgctctgcgaagaagtgagcgtcgacacgctagaaacaaacagcctctgctgcacagcagcaggcattattgctcctctaagcagaaccaccgaggcgcttcccccccacgaaaagctgcgcgaggcagccacacccaatgcaacgctaatcgctcagaatcgcccgcccgcgcagcctgctgaggggtgtacgcaccctgaatgcattctcgaaagaccgataaggatagccgtcgacgtagtccagatcgacgagcgcgccgagttcgagaaagagtttccaatacctgaaggcttgcagtactgcaaaaagcgcgtgacgtacattaggacacgagtaggaagtacatctgacacgttcgcccgcgagcattacgcctataaagcgggtttcgcagcatggatgcgtcggtcgtggaagcaggcagcgctggagtggtcgaaaaacagcggtgaacaacaggatcaacccgcaccccaggagaaaaaatgaacactgctttcatcctgatggctcagtacaacggccaggcgatcatcccattggacagggtctgcaaggactactttacgcacctgaccaccgatatgttccagcgcaaggttatggccgggcagatcaaaatcccaatcacccggctggagccgagtcagaaaagcgccaaaggtatccacatcactgatctggcggcctaccttgatctgcaacgtgaagctgcggtgaaagaattcaaccagctcaacggataccgccgagccagttaactcactgcttgccccaggcgcccagcttcacgggcgcctgaatgatcctctctaaccacggccattcggcatagtggtcacctcgcccgcgcagatgggtgtatctacgcaatgaattccaatcccgatgcccggaaacactggccactcgcgggatatcccagtccatttcaaataaccggctcacgccgtcgtgccgcagatcgtggaagtgcagatcttcaaccatcagaaacttgcaagcctttgcccaagcagtggcgatcgatgacgagttgtaagggaaaatctctgcacgctcctttggcatgctcttcagaatgcgccaagcttcatccgggaggtgacaccaaacatcgttgccaatcttttggcctgggttcttcatgtcccgcaccatcacccgctgacgttcttcatcgacgtcctcccaaagcattcgaccgatctcgtcttgcctacgagtggagaacaatgcgaagccggtgactttgagcatgttgatcgaactagggcgacgctgctgaatgcctacaaagtgctccagcaccttatccagctcgtccttggtcggccgccgatcccgttcgcggcttttcatgttgtaaccgagcttcctcaacaccttccgagcgtccgacattgcgtgagggtctacctcatacccccaagcgggacgcgcaatcgaaaggacagccccaaggtgcgccagatcgttgccagccgtctgaggctggacgccgccgccctctttactcattcgccagagtgcaaaatccaccaatcgttgactgttgatagccgaatcaacggtctggccaaactccgtcgccgcaatagcatttagggtggcttccttggttttacccaacggccggactttctccatttcatccaggtactgcttgatcatgtcctgtactgtgacgcccttgcggttcgcccgctcaatcgcaccaggctgatctagctctgcctcacgtcgccgcacccacgcttgtgccgcctgtttccgggcgaaggtctggctctcttggtagacttgcgttccatcgcgaaacaggcgtatctgtgccgtgtaactgactgagccatcggtgcgttttcgtgctctgatcgttgccatgatcgactggtacaattccgaaagtgattggtacattgtaccagcgccatcgaaaaaacgcctgaaaacgcctaaaaaaacgctataaatacgttgagccaaatggtaccaaatacccactcaagcccagtaaactcgagccctgcgctatctcggcggttttccgttgcgcctatgatggattggactgaccgccattgccgtttcttcctacgcctcctgtcgaagaacgccctgctctacaccgaaatggtcaccaccggcgcgctcctgaacggcgatcacgaacgcttcctccgtcacaacgaagccgagcaccctctcgccttgcaactcggcggtagcgttccgttggatctggcagcctgcgcgcgcatggctcaggaacacggctacgatgaggtcaacctgaacgtcggctgcccaagcgatcgtgtgcagaacaacatgatcggcgcgtgcctgatgggtcacccgcaactggtggcggattgcgtgaaggcgatgcaagacgcggtgtcgattccagtaacggtgaagcaccgcatcggcatcaacggtcgggacagttacgcggagctgtgcgatttcgtcggcaccgtccgcgatgccgggtgcaccagttttaccgtgcatgcgcggattgcgattctggaggggttgtcgccgaaggagaatcgtgacattccgccgttgcgctatgacgtggcggcgcagctgaaggcggattttccggagttggagattgtgctgaatggcgggatcaagacgatggaggcttgccatgagcatttgcagacgttcgacggtgtgatgttggggcgtgaggcttatcacaatccgtatttgctggcggaggtggatcagcagttgttcggcagttcggcgccggtgatcagtcgggctgaggcgttggcgcagttgcgtccttatatagccgagcatttgctggccggtggggcgatgcatcacatcacacgccatgtgctgggtttgggcactgggttcccgggggcgcgcaaattccgtcagttgttgtcggtggatattcacaaggccaaggatccgttggccttgctggatcaggctgccgagttgcttgaagggcgttaatcccctcctcttacactgcgccaggcggattgctccgcctggcgtcagcattcagacggccgctgctgcggtccagttgacccagccaaacagccacgttgccagaatcaacaaaccaaacgcgatccgataccaggcgaacgcggcataactgtggttggcaataaacttgagcaagccgcgcacggcgatcatcgcgaagatgaacgcggtgacgaagccgagggcgaagactggcaggtcgttgggttggaacaggtcgcggtacttgtagccggagtagacggcggcgccgaccatggtgggcatggcgaggaagaacgagaattcggtggcggctttgcgcgacaggccgaagagcaggccgccgatgatggtcgagccggagcgcgaggttccgggaatcatcgccaggcattgtacgaatccgactttcagtgcgtgagaccagcgcatgtcgtcgacgtgttcgacgctgatcacatggctgcgctgttcggcccacagcatgatgatgccgccgacgaccagggccaccgcgacggtgatcgggttgaacaggtattcgtggatcgcgtcggcgaacagcacgcccaagaccacggcgggcaggaaggcgatcagcaagttgagggtgaagcgttgtgcattgcgttgagttggcaggcctttgacgatttcgaagatcttcggtcgaaactcccagacgacggcaaggatggcacccagttgaataatgatgttgaaggccatggcgcgttcaccgccaaattccagcaagtcggcgacgatgatctggtggccggtactggagatcggcaagaactcggtcaggccttctaccgcacctaatatcaacacctggaaaagggtccagaaatccattaatcctccgtcagagcgctcttgatgagcgaccgggtaataacactcaggggttgagtatctgaagttacacaattggcgtatatgaagatcaaaagatcgcagccttcggcagctcctacatttgtaatgcattctcctgtaggagttgccgaaggttcgggccgcgatcggacgatcttttgatcacaaagaataggtcttatgaattgtcacactcaagccatgttagtaatcgtcggctgacgaactacgcagaaaatatttaggcctttttgcagaaaaaagttgccctgggaataaagtgtgatcaatatcacattatccagagatggccagacagtggcaattggacatggacaaagccatcgcaataagctcaaaatagtggcaccattgcatatcgccaccatctaagcagtagttcacccctccgagaaaatcaactaaaagcttgaaaagcttaattattgttagaaaactcgcgagacacgtctaaaatccgcgcaaatgttaccaattgtcagtcacagatgagaaccggtgctttaacatcccgatgtcagcactaattcgagtcaatgcacgatgctctcagggaacttagcgactagaagcccgcgcccgacaaatgacgaacctggtgttctcactctgggtcgtacccgtggcgtggctgaacattttagagcgctggtcgccaagcatgtgcacactgagatggcacttgaggctagttcctacactagctcatatcagctgaatgaatattgcggctcttatcgggccatctttctggtcatcgacaacccacaggcgctggaagacaatctggcgctggtgcagaacctgcgcaacggtaacttgaaaccgatcatttgcgcggtcctcaccggtcgtggtgcattcaacaagatcaaatactatcttgccggcgcggacgcttgtatcaaacttaataccgttgccgatgacggtgccgatttgctgagtgagttcttcagcagcgatgagtggcagcgcgatatcaacctcacgcttgatccgacgcgtatctgcctgatggacaccggcaagaaactcgacatctcgtttgccgagatgaagatcctcgaagcctttgcgcaaaccagtaatcacatactcagccatgatgaaatcgccagcatcatgggcctgaacaccaatttctacgaccctcgagcgctggaaaaatcgatcagccgcttgcgtggaaaaatcaaggacatgtatggtacaaacgcgattcagagcattcgcggctatggctatcgcctgctgcggggtctgatatcgactgcctgactcaagggcagccacccttttgcatgcgtacgaaggatcgtctaatgcaaccatatcgttctatctgcatctcacgcctattagaaatcaagcaattgaatgagcgcggcaacacgacccataacaataaaactccataacatagcagcagttcgagtggaatttatcgaggccattcttgggcccagaccctgcctatcgattacttccgaggaagtcattgctcgcctgccgatttatcttttagccaattttggtgtgtatttaggagagagacatggaaactagtacaaccctcccaaggaaatattttgttgtcgtgactcacagcacaacgtcgcaacgtgaactggaaagcatgttgtccagcgaacgcttcaattcgtttggcaactctgaaggtgttgcatcgccctcctccgcgccaatggtgatggagttcacatatccaagcgtcagtcgaaagaatgttgctcgcagtattgagcatgatacccagcgaatcctagcgactcttgagtccgaatggctggctgcgcaaaccgccaatccttttcaaagcatcccggcactgactggcgaaagcagcaatatgccaccagccattaaaggcgatctgccttgcagcgaaacctggcatctcgacaatgatcagggtgcattggtcaaagacggtatcgagatcagtctgactggtctggaaacagctttggtgaggaaaatgctcaatcatgaagagcgcgttgtcagccgagacgagttgatcctcagtatcggtcgagagcccgagcaatatcgcggtctggaaatgtgcctgagtcgccttcaagacaaattcaaaagcgccagtaatggtgagcgcctgtttcgtgctgtaagaaatcgcggttactgcctcattcaggaaatcgttgcgtaaacacgcagccgattccgcgaacaaaacaaacagatacaagtgcgattacaaaaacaacaagagcactctgtttggcttcatcttcctccctgaattaaaaattccctgcctccacccctccaacagtaacaaatacaacatcatttattcaccccctgctctgcgaccttttctaacactgctctatttaattattaaaaagttggcactgtgccatcttgttagaactcgtcagacaccattccagccaataacttagtctattgactgacgacagttcggcatatcgatgttgttacctcaggacactcgttaaaacaaaaacaataagtctgcataacaactcggatttcaactgttgaaacctgaatggacgtcttttggggataccgtatggatctttctctaagtatcaatcgaagcacaggcctcaagggactgaccttttggggccaatgggcgctggcgcagggctttgtcgtgacgctgctgttcatcctcgccgagcatcacaccgggacggtcgcgttctactaccgaatgtgcgccactcttgcggtattggcctcggtgccggcgtatacgttcagcggtgtttatcgcaaacgcgataactacctgaccggtctgggtcggctgttcatggggtggtcgatgaccatggccgcgctggcttgcattgcgtttgtttgccaggctgatgagctgttttcgcggcaggtgattctgagctgggcggtgtatggcttcctcggtcaggcatttctctatgcgccgttgcatgcgttttccaagtactaccagcgctcgcgcaaaagtgaacacaagacgctgatcgttggcacgggcgacctggcgctgggtctggcgaaaaagctcagtcagttggagaatctgccgttggtaggtttggtcagcaacggtgatgtgtcggcgctgggtaaagatgcaccgcgtgtggtcggcgctcaggaagacttgctgaagctgattgaagcccatgacatccgtcgtttgtacatcaccctgccgctgtgcgaagccgcgaaaatcgaagcgatttatggcgatttgctgggtgccaacgtcgacgtggtctgggtgccggatctgaacgcactgacgctgctcaatcactcggtgaaagtcgtggacggcctgccggcgatttacctcaacgagagtccgctgaccagccgccctactgcggctttgagcaagagtctggttgagaaaaccgtggcgtttctggcgatcattgcgctgagtccgatcctgctgatcatcgccctcgcggtgaagatcaactcgccggggccggtgttcttcaagcaggatcgccacggctggaacggcaaggtaatcaaggtctggaagttccgctcgatgcgtgttcacgatgaccgtgacgtgaaacaggccagccgcaatgactcgcgcatcaccgcagtcggtcgctttattcgccgcacttcgctggatgaattgccgcaactgttcaacgtgctgcagggacacatggcattggttggcccgcgtccgcacgcggttgcgcacaaccatttctactcggggaaaatcctcgcctacatggcgcgccaccggattaaaccggggatcaccgggctggctcaaatcagcggctgccgtggtgagacggacacgctcgacaagatgcagaagcgtgtggagattgacctgcagtacatcaacagctggtcgttgtggctggatctgaagatcctggtgaagacaccgtttacgttgctgtcgaaggacatttactgaggttcagcgctgcacaccgcaaggggacgaaagtccccttttttgtgcctgggatttgaggatggaatcggatcttggatggatgcaaaaactgtgggagcgagcctgctcgcgaaagcagcgggtcaggtaatgatgatgcggactgtgccgacgccttcgcgagcaagccagctcccacagggattcgggattggctcgggatttgtggcgtgacaaataaccaatgtaggagtgagcctgctcgcgatgacggtgtgtcaggcaacagggattgtcgactggtttgacgctatcgcgagcaggcgaaggcctacaggggatttgtggttggctcaagccttgtggctagacacataacctgtgggagctgcggtgcgacgattcgacttgccagcgatggcggcggttcagccaatatcaatattgaatgtgccgacctcatcgctggcaagccagctcccacaggtttcagaggtgcttcggagatccgcgcttactccgtaatcttctcgaaattgcgatagaacatgtccccttcccggctatcggtcatcgagtgcagctggaagctgcggttcaaacgtgcaccaccgtcacgggtcagcggtgcccacaccaggttggcgcggcgcatggtcgacatgctcatcatttcgtcgaacgggatggacaggtagaggcctttgtcgaaactaccctcgccatactcggcgctgctggccgtggtgatcgtcgcccaggcaccaaagcgcacaccattggaaaactcgcgcgagatgtccagcgtgccgccccaatccccggccaggtatcgcccgacgctgacagccgccaatgtatcgaacggcaaatcggtatacgccgtgacatgcccggtcaccaccgagtaatcgcgcaaggcaaagccctgatcgaaatcccgctgacgcacccagttgatatccgcccccaccgaccagcgctcaccggtcggacggaacagcacttcaccgcccacaccggcaaacatcgactccagataaccgccatacaccatgccatacaggtctttatccaattgctcggcatggctgacctggaacaacggcatggtcgtgttggaggtggtcaagtactgacgcaaatccgtgcgcacacggggcaaaccactcggtgcgtcgtagacgaatttgtcgaagttgttgaccaggttggtgctgagcaaaccgttccaccaggtgttgcgattgaagcggtactcggcgtcggcatcggcggtgaattgatagagcaaaccatccggaccaccgacgttctgcttgaagcccaggcccacaccataactgaaatgctgcggtgcttcggtgtagagggttttctcgttgtgcggcatcgccgggttgatttcggtggtgcggtgcagcgataccagcggctcttcgttgttgatcacttcacggaaggtctggcgcggcacgctggtttcttccaccggcaagtcgtagcgtttgttgaccacggtgaaccagtcgatgtcgtcgttgacgctgttatccagcacccggctcgcccgcccgacagccttgggcgaatggaagtaacgctgctgctcgccgtagacgatcaactcggaatcgcgctgggtaatgcgctcgactttgtagccggcattctgctgcaggcgctgcgaaacgttggcccaatcgacctgatccatcgccgtggtcggtgccttcgccggcagcggttcaggggtcgggtcgtaagtcttggccggcgccttgcggctgacgaaattggtgtggaaggtcacgccgaacatcgccgtattgccacgctcccacgcagcgctgaggtcgatcgaatcggtgactttgaacaccgcgccaaggttgatcggcgagtcttgcttgatgatgttgtccttcggttcgttcttgtaatcgttgccttcgtattcgagtttcaggctgaggcgatcccacggcgtctggtaactcacgccgccgaaaaacgaaggtcggccacgaaaatacgaacccgagttgacgtcaccggtgccttccagctctggccgggtgtcgaagcgatcgctgacatagcccagcgggttatcgatgtcgccgcgattgccgagatacccccaggcaatcccggcgctgaaatcgaaattgtcatagcgcttgttggcgacgaaaaattcactggagaacaaacccgtaccgccgatgtctcggaaacccagcgccacatcgggcagccagtgactctcctgccacagccggactttgacgtcgaccgccttatccttatagctttggctgccgctgagggcctccgagccgtacggccggttggtgatcgcggtgtagcgaaacgagccttcgagccagtccagcggttgcaacgaaacgctgtagcggctgtacggttcggtgcggttggcgttgacgctcaactcgccggccggcgccatacgcgcggtcggcgtctgcaacagaccggtgccaccgaagtcattctgggtgatgcgcggctcggcatgggccagaccgcagggcaataacaacacagctgcaaaacgtaacttcaacgaaccacctcggccagctgcgtggcaataaattcggccaactgctgattcagttcaggtagaggcggatccagatcatcatttttcagcggcaccagaatcttgctgccggccacgggaaagtgcccggactcgcgattccagtgggcgatgccgacccgttgcgaggcgccgttgggctgaatcagccacagataatcggcctcggcgtcgctgagaatcgagcagccttgcaggtactcacgagcctcctgcaacggctgatacggcaagtggcacggctcggcgacggcgcccagcacttgcacttcgtcgacgcgcttcggatagaccagacgatcgccatcgtcgagacgaatgttgcgtgcgaagccgacttccaacgccaccggatcgagatcggcgatctgccgcccggttaccggcatctgccgcacttcctcggccatgcgctgcgccaacgccgcgcgactcgggcgatcgaaaagcatcgacatgcgctgcagcacatccagatcaaacagcacgccgaccttcagccgtgtctgctcctcaatcagcgactgacgcagcaatccgcccgccagccaatagccttcggcattcggcacggcttcgccgatcacatcgagcaggcgcccgccgggtggcaaggcgaccggcccgggattggcgacatcgcccgacaccgtgaccgccgcctgactgacactggcgatcaacatcaggctcgccgataacatcctcaggcgcatcacggcaggtgcctgcgatcaggcgtcagctgcacgaccttgacgcgcaactgcgacgtcagttgctgctcgctctgcaagatgaaaccgtcgcgcgggtcgacccagtaatgattggtcgcgctcagaccgatggccggcgcgtcaatctgttcatcgacacgcagcacgctgtattccttgtcgagaatctgcagggtttgttcggagcggcgcgagaagcgactgttgacgatcacgccgacttcctgacccttgtagaggtcgatccagcgccgcgtggtgaaaccgtccgccacgtgatgcaggccttgcttgaatggcgcgtcatcggccagccgcgtgccatcgagatcgccttccaggcccaggccgacgctgcgcacggcgaggccatcgcgcagcaacagcacctgtttgccggacgcgacccagaactgcaggtcttcacgctcgcgcatcagcgccaacaccccggagccggacggcgtggtcagtttcagttgcggatagttgaccgcagccacttcggcggccgtcacgtccacttcgtcggggccgacgaccgcagccttgaggttgttcagcgaagcgctcatcaaagggttacagccacacagcaacgaggccgccatcaggcacaggccaactttcagaatgttcaaagtcggcgaccttatttgctgttgttactgtattcgctccagttcttcgcagcggaagcgccagtaccgacaatcgatgccgacggcaccaattgactgatcagacggttccagcgagtcacgttggcaggcccgacatacaccacgtcctgcgggcgaacttcgaagtgcgaagcgagcgccatggcggtcggcgactcggcttcgagctgatagatcttggccggctcaacgtcgagattttccacgccacgaatgacgtacaccgcgttgccattggaggtggtctgggccaggccgccgaccgaaccgagcacgtcggtgaggttcatggttgcggtcttgaagctcaatgcgcgtggctgattgacctcgcccatcacgtagatgcgcttgttgtcgttgtacggcagatacagctgatcgccgcccttgaggtagacgttctgcaactcggaatcctgttgattgagcgagtcgagattcagcggataggtgcggcccttgcgcgtcagcagcagcccggacaaatcggcattgttggtgtcgataccggccgagccgagggcttcgaccacgctcagcggattggtcgaaatcgcttgcggcccggccttggtcaccgcaccggtgaccacgactttctggctggcgaaacgcaacaccgcgacatccacctgcggctcggcgatgaacgccgacagccgctgttcgatatccgagcgcagttgctggatggtccggccggcggcctggacttccttgatgaacgggtaatacagcgtgccgtcggagcgcaccagtcggccgttggcatcgatctgttgttgcgcgccggacggggccgtcagctccgggtggtcccacaccgtgatgtacaggacatcgttgttgccgatgcggtactcggccggggtcgccaaaagctccgctggcagcgactcacgcttttgcgtggcgcggttcatggcaatcagcttgggggtgatcggaatcagctcgacccggctgctttcgctggcgccctgacgggtgatgtcactggtgctcaggtattgaccgggggaaaacatgcaaccttgcaaagcgagacttgccaacattaaaagataaacactacgagtcataatggcactacgctattcaagggcgaatccaaaaagaaagtcacccgacttgcgtcgggcgaccttgtactgcactaacaaatgttcctgttagttatgcgtgccggttgtaccggtggtacctgtggtaccggtagtaccgccgttggcactgccaccgctgttggacgccgctactgcactggcaaccattgcagtactggctgccggcgcttgagaagccgccacattgccacctacattggttaccgccgtcagcggtgcttcagctgcggcagcccagttgctcaacatcgtcaacagggcaactgccatcactttcttcataacaactcctttctaacattcgacctgttaaaaaaccggtctgagtcagagttggtagcgttcaagtccgcaaaaaacgcgaacatgatccgtcgttctttcacagtcttacccaactgataaaagtcgaacggcaggtttatatctacggacttgcaaaaggcattgccagtgtaatttcccgacgttatctaacaacctgactgaaaataacatcgaactaaatggccatcatcgcaagtagcctttgggatgattcgattgccagcgccatgtatcggtgaccatgtcctgcaagttgcgcgtggctttccagcccaactctttttcagccttggaagcgtcggcccaactctcggcgatatcaccgctgcgacgcggcatcatgcgatacggcaccgcttgcccgcacgcctgttcaaaagcctgcagcacttgcagcacgctgtaaccatcgccggtgccgaggttccaggtatgaatgccgctgcgatccgagatcgactgcaacgccttcaagtgcccatccgccagatcgaccacgtggatgtaatcacgcacgccagtgccgtcgatggttgggtaatcattaccgaagatcgacagctccggcaggctgccgaccgcgacctgactgatgtaaggcaccagattattggggatgccattggggtcttcgcccatgtggccgctgtcgtgcgcgccgatcgggttgaaataacgcagcagcgcgatgccccagcgcggctcggcctgagccagatcgcgcaggacattctcgacgatcaacttggactggccgtagggattggtcggtgtacccgtggggaaatcctcacgaatcggcatctgttccggctcgccatacaccgtggccgacgaactgaacaccaggcgaaacacccccgccgccgccatcgcctggcacagattaatactgccaccgacattggtctcgtagtaatcaagcggcttgcgcacgctctcgccgaccgccttcagcccggcgaaatgcaacacggcgtcgatggtgtgctcgcggaaaatccggtcaagcagtgcccggtcacagacatcgccgcggatcatccaggcactcttgccgcagatgccttcaatggcgtgcagggccgcttcgctgctgttgcagagattatccagcacaacaacttcataacctgcttcaagcagcgcgagtgtggtgtgcgagccgatataaccggtgccacccgttaccagaatcttcatagcgcggtccgtctgtggataagtgccccgtggtgtgtcaagcctcttgcatgggatatgtgtcgtaatccacacaaataaggcgacaacaacctcaaacaaatttagttcaacgactggcaataaatatttttgcaggtcaaactgtattgccgggtacttattagcactccctgcgcactaaccactatcaacgcttaccgactaaaaataactaatagcgcactaaccgacatctcataacattgccatgttttaacacctctgcacattgccatgaataacctgactcaggtattaaatcactcgttcaataattattgaaacttgcacgccctctattagtgcgcgcatccgtcgcctgtgttccatgactgtccaggatacttttatgattcgtaaatgtttgttccccgctgccggctatggcacgcgtttcttgccggccactaaagccatgccgaaagagatgctgccgatcgtcaacaagccgttgatcgaatatgccgttgaggaagcgcgggacgccggtctgcaacacatggccatcgtcaccggtcgcggcaagcgtgcgctggaagaccatttcgatatcagctacgaactcgaacaccagattcgcggcaccgagaaagagaagttccttgccggcacacgtgaactgatcgacacctgcaccttctcctacacccgtcaggtggaaatgaagggcctgggccacgcgattctcagcggtcggccgctgatcggcgacgagccgtttgctgtggtgctggccgatgacctgtgcctgaacctggaaggtgacggcgtactcacgcagatgatccagctgtacaagaaattccgctgctcgatcgtcgccatccaggaagtcccggctgaccagacgcacaagtacggggtgatcgccggcgagctgatttccgacggcatctaccgggtcaacaacatggtggaaaaaccggcaccgcaagacgcgccgtcgaacctggcgatcatcggtcgctacatcctcacgccggatattttcgacctgatcgccgacacccaaccgggcaagggcggcgaaatccagatcaccgacgcgctgatgaaacaggcgcagaacggttgcgtgttggcctacaagttcaaaggcctgcgcttcgactgcggcgacgcagaaggttatttgcaggcgaccaacttctgctacgaaaacgtctatctcaagggccgctgagacggctccccccacccaacgaggccaccatgaacattgcacaacattccgtagagattgaacgcgaggtgggtaacctcggggtgatgagctggttgtcccgccatcagccgttgcccagcgccaacgaaacctggctgggcacgattctgctggtggagcggattggcgtgtttcccgcctccggggatatccgccggccgctgcgcgatccgtatccgctgctcgcgcatttgaaaaagctgtatggcgagcaggcgctggaaatggatgaccgtgatgggctaaaggtgatctttggtgactggcgttttcgcgtgcggatttgctgcaacgacccggcgatcatcatcaacgtggaaacccgttgcgatacgcgcttgatgccgcagaagattgccgagttgctcgagcaagtcgacgccttcgaataactcccctcaccttatcgttcccacgctctgcgtgggaatgcatccagtgacgctctgcgtcacacagcgaggggacgcggagcgtcccgggcggcattcccacgcggagcgtgggaacgatcaccgctctggggttttcgtgttatttaggggaggcgtcgcaacggtccttggcgcccgtgatccagccataaaagtaatcggcaatcaccttcccgcccgtggccggcaccgggtgaatcttgtccgggccaatcatcgccgccgcgtaacgtttgacgtcagagccaaacgcacactgaagattggcataccccagacgctgctcgcgtgcccacggctccagcacctgcgcatacgccgacatcgggtaagcgctggagcgcgtggtgtcctgacgcatgatcaggttgatgctcgcctgcggttgaatctcgcgcagcatgcccaccagaccctgaacgttctgcaggtactgcgccggcttcacgccgaagccctgatcgttgccaccgagcatgatcagataaacatccgcaggaatcttcgataccgcggctttccactgcacctgccactgcgggtcctggtgatagaagtccgcagaggccgcaccggaggccgcgagcttcgaaacccgaacgcctttctgatcgttgctcatccataagccgaacaacgtcggcgagcccctcacaacttccagtttgaaggaccagtctttcgccgccgagaggcctgtcagtggcacttcctgaacgcccgaaccctcaagcttcaacggttgccagtcttgcccgggcgcccagcggtagcggatctcgctggattcgccgttgcccagataaagcaatttcgcctgagtgacagcagtatcgatgcgcggcgtcgcagtcgcatccacttgcaaccatgcaccgggtcggcctgtcaccgtgcgactgtccggactcgcctggcccaggtctgacactttccagtcaccggcaaaatacttttcactgctgcgggtgtatttgaaatgcgtgccgcccagcgccgcgccgtgattgaagccgacataaccgggcccggcaaaaccgacctccccggccacgcgctgcaccagtttgttcagatagaaatcctgcccggcgctgtagctgtcgccaatcaccgagaccgacaacacgttgccggccttgccttcgcgccactgcgcaaaacgctcacgggcatcgcccacctgaaccaccgacgctgcgacgggttgtgcgtcatctactgccaacatgcaaaatttccttcagtctggaatggcccactgaataccgggatgtacacagatcaactgtaggagcgagcctgctcgcgatagcggtgggtcaggtaatgaaatgctgactgacagaccgctatcgcgagcaggctcactcctacagggattgtgttcgacaaagatccgctgctcgcgaagctcttagctgctctgggtttgcaccaccggggtaacggacaccaacggtttcttcttcgccgcccgctcaccaagaaacaacaccgaggtgaaattgaaccgactgaaaaccatcgacaacaccaccggcccaagcaagccacaactcaagccgcccagcaccagcaagctctcatccttcacccccaaccgccccagcacaaaccgcgacgtcgccgcgaacagcacatgaaacaggaagatcgcataggaataaccacccagccacgtcagcgctttcgagcgcacatcactcgacagcaacgcgatgcaagacacgcaacccacggtcaatccgatcaggctacggcgatcaacaatcaactcgcgatcaatcgccgccacgtacagcaacgtcaacgagatcagcacaaataccaacggcccgatcaccttgaagcgctgcttcagcgcatcgacgttctcttgaccaatcatccccgcgacaaaaaacggcaacagataaatcgcgccgttgatcccgaacgcatcgaacttgaacggcggcagcagaaacaacacagccgcgaacgcaaacaacccatacaaccgcatcgccgaacgcaacatcccgcgccactccagcagcccgacgaacatgaaaatgatgaacaccgcctgcaagaaccagaagtggttgatcggcacccagaacgacaacaacgcgtcgagcacgcttacgtccttgttcacccccggccccaccgcttgcagcaccgagaacggcacaccgacgcaaaacagcggcacgatcaagcgacgtaccttgccgctgaagaacgcggaaaagtcattgccgcgaattttataaatggaatagatgtacccggaaataaaggtgaacagcggcatgcgcacgtacaccatcgaatcggcgatcacccggaacggcgagccgatatcgatcttcaacccaccgcccaacggcccgatgacgtgatagagcaccagcagcaggcacgccaggccacgcagggtttcaatctccagggactttttcttgctcgacataaagcacctgcctcaattcagaattcgtgattcaacctgcaccggtttgttcgcccgcagcatcaagcccagccccacgaacaacaccggcaccaccatcgagaagtgccgggcgaaagagccgaagtccggttcgaacaacccttgcaccagcagaaacgccagcggaatcgcgatcagttccttgggtttggtctggatcggcgcgcctttgtagtcggtcgaggtgatgactttgaacagcagcagcgctgtcatgatcatcaacgccacgaagatcacctgacccgggccggacagcagaatcagctccaccgggaaggataagcggaagaagatgatcatcgagtccagcgcttgcgaaacgaagtcgctaccggtgagccacgagacgatcaaggatttggagccctcctcgcccgccgtgcgcagttcgttgttgctggcgcgaatcgacgacaccggaaaccccaaagcgacctgaatcgccatggccacggccagataaaacaggaataacatcaagaaaaaggtcgtgcgcgacacatactttttcatcacgcagacaccgatccacgacagcgaaaacagaatccagtaaggccggatcagcacgccatagatcaccgccgagaggaaaaagccgccgcgatatttgcgcgtcagcgagctgagcaaaatgctcaacaccgccaccgacacgatgatttccttggtcaggttctccaggaaaaacgagcgcacgatgccccacagacacaaggtgccgaagatcgccaacggcatgcgccgaaacaccaccaccggaatcgccgtgaggaaaaagttgcagaacatgccgtaggcccaggcattggtcaggttgatcccggtgggccgcagcaggaacgccgaacactcgtaggacgagcgatccggcgagaacgggttccagaaattgcagttgtcggcacgggcgtaagacgaccacaaggtcatcgcatccgggcccggatcacgggggatcagcagcggcatcgccaccgacagaaacagcccggtgaagaggatcaggaacgacacatacgaatcgagtcgcttgccacgaaactcgatgcacggcagtttcaggcccatgacaacgcagcctttttcgcagcggttgcgcgggtcagcacggcaatcaccacgagctgcacgatgatcgcgaagacgttgccccacgccgcgccataaatcgaatagtgcttgatcaacagatagctgaccggcaccgaaatcaacaaacaaatggccgcgctagccagtgacacccggctgtttttcgaagcaatcagaccgccccagacaatgtcgccaatcgcgcgcaaggcgaaggaaaaaatcagcacaccgagaatggcgttgtccggacgcggcacgctggtggcgacgtaatcgagcaccacgttgaagaacagatagatcgccaccgccaccgccgccgacaccaccagcgagcgcatcacccacttgttgacgaacaactgcttgaccgtgaacgcctgctgatcagcttgaaaacgcttggccagcaccggaatcccgaccaccgccaccaccgcgtacgacaacgcttgcaaggtgttcgccgccgaccatgcgtacacgtatttaccgaggctggcgtagggttccaggtcgatgatcagaaagcgctcggcgtactgactcaacgcgatcagcccggtgccgaggtagaacggtaagccggccttccacacagtgcccgtcgccaacgtgccgctttcgcggcccttgtgcacgttcaccacaatcaggtaaccggcaatgatcaccagcacattggcggcgacccacagccacaacacgctggcgatgcccgacacccagccgagcatcatcccgcccaccgccagcaccgcccacaggccggtcttgatgaaaaacagcagcgcgccggcggtagctttctgcgcggaaaacacgaacgagttgatctcgaacgacaggtgctcagtgagcaacaccaaagtcacgcagaggatcagcatggccgtcgcttcaacctgctggaacagtgaataaatcagcactgtcaccaccgacagcagcaatcccaccgccagatacagcagcaggactttgtcgaccacccggcgcgaactgccgccgacgctgatcagccgattgatctcggaactgaaaccgacgctgtagaacttcgaggcgatcaacgaggccgcgaccaccacgccgtaaaagcccagcgcctcataaccgaggtaatgggtgatcgccaacaccagcaaaaacttcgcgcctaacgctccgccgcgaagcagcagccgaaatatcatcgaacgacacccttgatgatctcgtccatggccacggttttcgcttcgatttcccggcaggtgtcggtcaggcgcttgccgaaatttgtcagcgcattgggcgcatataccgtgtcgatgatcttatcgacatcgatgtcgccgccattgatcacccagtcctcgacgcccatgtcctgataggcgccaaagcctttgcgctcgtagctgatgtggtacgccggcacgccggaaagcagcgattcgatggcgccgtgcaagcgcacggaaatcaccaggtccggttgatacttggcaatcgtcgccttcaacgacagcaggtcttcagtgatgcccaactcgcgatagaacgcgccgtcatcgttgccgcgcaccgcgctctgcaccgcgcagaccactttgcttttttgcttcaagcgctgcagcagcaacttcaggttggcaacgtaagcgactttcttgtctttgctccactccggcggcttgcgcagcaccacgcagaccgtggccggcgaagcggcgcagcgggtgaattttggctgcaggaggatcttgctcgccagcgactgcaccgccagatccggtgcgcgatagacgttttcgcaggcgtcgaaaatcgccgaggaacggttgtctcgcacgaacaccgcatcagcgctggcgtagtgctcgacaatcttgctgctctcgccatggaacgggccgatgctttgcggcaagtacaccgacggcactttgctgaggatcgcggtttccagttgtttggcgtggccgagtttcaacttgacgtgttcgaaggcacttttcgagcgcatatagccgccaccgacgccgacgatcagatcggtttttttcaacagatccgccagcccggcgtaggactggttgagaaacaccgcttgtttgacccgcccaaggcctttggccgccatcaccggcgcatcgaaacgcgggtgcggcaagtagctgaaagagtccgggtcggaagccaccacactgatcgcggtgtcttcgccaaagttgcgctgcaccagggcgatggccagatcgacgagcaggccgtcaccggagttggacgcactgtagccatgcaaaatcgttacgttcatatgcttgagttctacttaaaaagtgggagcgcgatacaggtcgtaggtctggcgaatcatcaacgcagcgctgaaacgctcgcggacgatgctgcgcccttcgttgccgaggtcgagcaggcgcggcttctggatttttttcagcacgtcggccagcgcctggtgatcaccggacgggaagacgtagccggacacctcgttggtgaccaactcgggcagcgaggtgcagttgctggcgatcaccggcaagcccatggccatgccttccagcggcaccatggcaaacccttcccaacgactcggcacgatcagcgcatcggattgttgatacagcgcctgcacttcgctcggggtgacccacggcaggtactcgacgccgtccattggcgggcactcgaccgcgtcctcgttgacggcgctgccgaccacggtcagcttcatgtcgctgcgctggaccttggcgtaggccttgagcagcacgtcgaagcctttctgataatcgaggcgaccgacgaacagcagatgaatcggcgcagggctgtcagccttcggcgcgtcatcgcggtgatgaatgccgttatagatgagcttcatgcgcttgcgctcgatgccgaagcgcgcggctttgtcgagttcgtactggctgacgcaaatgatcacgtcggtgactttctgcagcactcgctcgatccacgcatagactttctgcttgatcggcgagctttccatcaagaacgaaaacgcatgcgggcagtaaacgattttcggcttgcgccacggtcgcaacagcacgcacacgcaacggccgatgaccccggaaaaggtgctgtgcaaatgcaccacatcgggtttttccttgagcatcacctgcgtcaggcgccaggcgaaacgcagcaacgacggcacgttgcgcccggtgcgagggaaggtgcggatctgttgcgcgccaatgccgtgcaactctttggcctgatcctccggcaccagatacaccagttcgtagttcgccgcatcgccttccggtgaagccgaaatcgtacggataacggtcgcgacgccacctttgatcgtctctgccacgtgcagtattttcttcacaaatcacccacttcaaacaggaaaaaacagtcgctgacagtcaggatttgtcggacgcgtattcgtagttgtaatagccgtaaccgccgttgccgtagtagctggccgcacgcttctcgacgccgttgaacaccgcgcctttcaactcgatgccgttctgcgcgaagcggcgaatggtcagttcgatctccttggccgggttcaccccgaagcgcgtgacgatcaggctgatcccggcttcacggccaacgatggccgcatcggtcaccgccaacagcggcggcgtatcgatgatcaccaggtcgtagcgctcactcagttcggcgagcaaatcgcggaagttggcgtgcatcaacagctcggaaggattcggcggcacctggccccgactgatgaagtgcaggttgtcgatttcgactttgttgatcgcctgatcgatgctgcagcgcttgaccagcaggtcggacaagccgttggtgatcggcgtgttgagggttttatgcaggtggcctttgcgcatgtcggcgtcgatcagcaccacgcgctgaccgctcaacgccatgaccgcggcgaggttggacgagacaaaggtcttgccgacctgcgggctcggcccggaaatcatgatgcggttgttggtcgaatcgagcccggcaaagtgcaggcaagtgcgcaggctgcggatcgattcgatcgacagatccgtggggttacgcagggccagcaagtacgccggcttgtcgacgccgtcgcgggcgcgaccttttttgttgtcttcttcatcctgcaaggcgctgtacggaatcgacgcatacaccggcaagccgagttgttcgatggcttccgggccttcaaggccacggctcagggatttgcgcagcagcaccagcgccacgccaacgaaggcaccgaggaaggtggcgatcagcacgatcaaagccttcttcggtttgaccggactggtcaggtcgacatccgccgcatcgaccaaacgcacattacccacggcgccggcgcggacaatgtccagctcctgggatttgttcagcaactgcgtgtagatctgcgaggcgacttcgacatcgcgggtcaggttgagcaattcctgctgtgtcgcgggcagatcgccgaccttgccttccagcgacttctgttgctgggtcagttcgccgatctggctcatcaacgcgcgataggccgggtgctgtttggtgaacttgcgatccatctccgcctgctgcattttcagctcggaaatccgtgtttccagcgccaccgactgaccgagtaccgactgggtttccagggagatgttcacggttttgccgtgggtctggtaggcgttcagcgcatcgctggccttggccagatcacgtttgacctgcggcaactggctttgcaggaaggccagactctgcgccgcttccgccgaggtgcgacgcacgttctgatcgacataaagtgcggcgatcttgttgagaatcttcaccgcttcagcggcgtcgctgctggccagcgccagtttgataatccccgactccttgccctgctcggagatatccagcgcgtcctgataaccctgaatggtcacgattcgtgggttgcgcaccacttcgaaacgggtgccggggttggcctgcagttgggtgatctgcccttctacgccgtcttgtgcgaaggcttcaccggcgacgccgtcgaccagcaggttgtcgttgtcatcgagcaactggaagtgcttctgttcgccagcgatcagggtgagtttcttgcccagcagttctttcggcaggttcagtcgggcaaactccagacgctcaccgccccaggcgtaactgttcaagccgaaacgcggcgcggcgacgctggtctcggtttcaccgcgataacgccgggcgagaaaaccgccaatcatcgggaaggtgttgggggtgacatcgatgtccaagcgcaggtcgtcgacggttttgccgatcaccgcgcgggatttgatgatgccgatttcggtcaccgacggcgattgcccaccgagcatgctgttgaggtcggagaaaccgagcatgtcgttctttttcggttcgacctgcaccagcgcgttcgccaggtacacgggcgtggccaacaccgcgtaggccacaccggtgaccataaaggctccggtcagtgcgccgatcaaccatttctggtcgatcaaactgccgaatataccgagcagatcaatactgtcttgatcattgtcgcgggtgccgattacggacggtaactgcataagtctgttcttaccattcattgatctgaagaatattcatcaacgcgcgaggcgttgtgcccatgagctgacagcatcttcaatcaatgcatgggcatgaataaaagcggccttgccttgacgatacggatcttgtatttcgcgctcgctctgccacttgccgagcagaaacactttgcctctggcgtgagaggcaatgttcagcacttgatttacatgctgcttttccatcaccagaatcaaatccgattcattaacgatgtcggctgtgagttgccgcgctttgaacgtttcggcactgtgcccgtgatcttcgaggacctgccgggccgacgcctcgacaccttcgccgacccgtgcggcaaggcctgcggatgtcacggtaatcgccgaggaggccaacgcattgcgcaataacagctctgccgtcggacttctgcatatattgccaacgcagacgactaggatctttctgaacaaggttttactttcctgtgtaatgtcaaacggccaacatccagagagcatttgagtgaaccctcaagaacttcctgcactcagaaatagattcgccctgttagtaccgaagcattaagtaccacagcgtttaaaagcaccccaaccacaattaacggactaaaaataactgtgattttcggctgtttgatttccgacaaaaaataacattcgcgcactaagtgccatcatcttgttcgaaaacggggtaacgagatcaatattcgtagttgtcacttctcttcgggagagcagacatgaaatcagcacatctcaaacgactcggcgcgctggcgctgatgacactgggtgcaacgactcaacttcacgccagtgaaacgttccccaatctccctgcgaagaacatcggcgttcaggtgaagattcagaacttctccgccgccgatgctgcacagatcaaaacggctggcttcggctttgtacgcttcggtgtgtggagcgacagcctgacggccaaggcttatcagcaacaagtcagtgacgcttttgccgcggccaggtcggcgggcctgccggttctgctgacggttcgcgccatcaaaccgttgcccgccgggtctgctgccgatctggcgacggctggtgaaggctttgccaaagcagtgacagggttgcaacagtcgtacagcgcgcaactggtggcgatcgaactatggaatgaacccgatctggaaacctattggccgacgggcaagttcgacaccacgtttgtgccgttcatgagcgcggtgtgcaagacgctgcaaggacaaccgtcatcgacgccggtggtcggttacggcttcgcccggccacccagcgcaggttcggcctccaccgtggcactgagccgtatcgtcagcgaatacccgaaatgcctgaatgccgtgtcctatcacccgtatggcatgacggccacgcagatcagcaatgcgcaggcattcattcagcagaactttcatctgccgggggtcatcagtgaatggggcatctcggcactcgcgtccaatggcggtgccgaaggtcaggcgagcaagatcaacgcgtttatcggcgatgttaaaaaactcaacatcccgctgacgtccatctatgaatggaagaacagcgcttcgggcagcaatgaacgcgagaagaacttcggcctgctgacgtccgatgggcaacccaaaccggcgcgaatgtcggtcgaaaccctgctgaacgcccaatagcgcttgtgcaaccgatctgtacgcaggtcggttgctttgaacctgttggtcgttttggcatcgtattcatcgatagcgcgccccgcctttcaaacaattgttttcaggttgttgccgcaggggccatcgatacacgcacacgcccttgagtgaccgccaacgctcgggtaatgtcatcagacccataggatagagcacgcccatgacttccaagctggaacaactcaaacagttcaccaccgttgttgccgacactggcgacttcgaagcgatctcccgggtcaagccggtagacgccaccaccaacccttccctgctactcaaagccgcggcgattccggcctatgccgagctgctgaatgcttgcgtcagcgactgcaagggcgatgtcggcctggccagcgaccgtttcggcgtcgcggtaggtcaggaaattctcaaagtgattccgggccgtatctccactgaagtggatgcgcgcctgtcgttcgacaaggatgccgtgctgaaacgcgcgcatcgcctgatcgagctgtacgacaaggccggcattggccgtgatcgcgtactgatcaagatcgcctccacctgggaaggcatccgcgccgccgaagtgctggagaaggaaggcatccagaccaacctgaccctgctgttctccttcgcccaggccgctgcatgcgccgatgccggcgtgttcctgatttcgccgttcgtgggccgcatctacgactggtacaagaaggccaacggcaacgactacaccggcgccgatgacccgggcgtgcagtcggtgacgcgcatctacaactactacaaagccaatgactacaagactgtggtcatgggcgcgagcttccgcaacctcaaccagatcgagcaactggccggttgcgaccgcctgaccatcagcccggacctgatcgacaagctggcagccgataccggcaagctggaacgcaaactggcgccgggacatgccggtgaagcgcgtctgagcctcaacgaggcgcaattccgctggttgtccaacgaagacgcgatggccaccgagaagctggctgagggcattcgtcagttcgctcgcgaccaggagaagcttgaggcgctgttgcaggccaagctgtgatttgagttggtgaaatgcaaaaagggcgaacctgtgagggttcgccctttttagtggctgctggaaatattcggcgttcttgccgaagctatcgcgagcaagctcactcctacaggggatctgtggagtgattgcgattgtgtgttgaatgaagaaccctgtaggagtgagcctgctcgcgatagggccagcagcccctaccccatttcaggccattaatgtctttcgagggcattcaccaggtcatggaacgcctcacgattggaatcgttcaggcccatgaggatcttgtgcgcttcgagcaccttgatccgcaccacttcttccgactggtcctgatccggcaggtcgtccaggcactcggggcatggcaccgggtgattgacgatgttgaacacctgctcgaaacccatcgattgcagcagacgggtgatgtcatcgtgggtggtgacgacggtcggcaacagcccgaccttctgccgcgacaggatcgacagtttggccagcaggcccaatgtcgtgctgtcgatgctgcgggtttcggtcaaatcgatcacgatcgcgttgaaattcagcgcggtgaagattttctcaatagtcgcatccaacgccgaacacagggtcaggcgaacttcaccgacgaacttcaggacgaaggtgccgtcctgctcggcgaactggattctaccggtactcattaaagattcctgctcaacaccaacagggcgatatcatccggcatctcccctagcgtggccaatccaaacacttgccgcagaccatccaggctgccgcccgccgacttcacccgttgaggcaaagcggcttctttttctttgagcgtaggttctggcaaaagatccagaatgccatcggacatcagcgtcaggctgaacgtcggcggcagctcaagcacgtgatcttcgtaggtggcttcattgaagagccccaccggcagaccacgtccttccagataacgaacactgtcaggcgtgtacaacacaggcaacggcagatggccgccgatgctataggtcaacaaaccggtctcctcgtcgatgactccaccgaccattgtgacgtgtttacccagcttacaactgatcagcccccggttgatatgaccaaggacttccgaaggcttgaattccggcaatgtgccgttgcgcttggattcaaacagcaagcgcgtggtcatgaacttcagcagtacggtgacgaaggctgaagaggcgccatgcccggatacatccgccaggtagaatgcgacccggcgctcgtcgacacggaagtagtcgacaaaatcacccgacaggtacaacgacgggatgatctggtgggcaaacttgaactcgtcgatgctccacggactttccggcagcatgttcatctgcacctggcgaccggcgttctggtcttcctggagcaggttcaggctggcctcaagctcgcggttggccttttccagcttctcgcggtagcgctggttctccagcagcagacgcgcacgatccagggcccggcgcacagagtgctcaagcacagccagatcttcgagaggcttgatcaggtaatccgccgcgcccaggcgcagggcctcgaccgcgtcgttcatcacgccggcacccgagaccacgatcaccggtgtctgcggtgagagctcggtgacctgacggatgagttcgagaccgcccatctgcggcatgcgcagatcgcagatgaccaggtcgggcgtgtcttgctcgaatacctgaagaccctgttggccgttgctggcctgcaggacgctgaaaccactgtcttccaaataggccgcgaggctcgcgcgcactacttcgtcatcatcgattatcagcagcgtggcactggtttttggcatgtgggcaaacggcgccagaattaggttggcgtagttggcggagcttaatggccctgcactgactactggattcgctttctagcctctctgctgcaccgctttcgggcataggccttgaacgcggttgcaccagaggtgcccttctaaggcgcagacggtactcccatccgcagagcgtttcaagcatgcgccgatggtcgcttgacgactttacttgtcaaatcaccgagagttataagaacagctcaaaccgtaacccaatggaaggacgaacctatgagtcaaaccggtcgggactacagcgaaaagcgcgatttcatccgcatgcgggtcgatgccgatgtcgtgttgattcatgaaggagatgaagtttcaggcgtttgcatcgacctctccagcagcggcatgcaggtcgaagcgccgcagctctttgcggtcggcgaccgattgagcgtacgcatcgactccgatcacgcggcactcagcggccttgaagctgacaccgaagtggtctgggtccgggcacaggacggcggcggccagaagctcggcctgatcattgtaaagatgaaatagctacacacaaaaaaggcgacccgaaggtcgcctttctttttaccggtcgagattaaaaatcgtcttcgacctggccatccttcaccttgaactcgcggttctgcaggtaagcattgcggatgaaggtgtacttgtcgccgctgatcagcttctcgctcgacagcaggctggcgcgggtgtcgacgatgttcagaccgaagatcgagttacgcgtaggtacgtggtcgatgtagcggtacatgccggtgtagctgtcgacgtatttcgacggcgcatcacgcagagtgctcgggcccatcagcggcagcatcacgtacggaccgctgcccacaccccagtagcccagagtctggccgaagtcttcgtcgctgcgattcaggcccatcttggtgctgacgtcgaagaagccgagcagaccgaacgtggtgttgaagatcagacgtgcggtgtcgacgccagcagcagccggtttaccctgcaaaacgttgttcgccaggttggtgacgtcaccaacgttgcggaacatgttgtgaatgccgtcttccagaaactgcggagtaacgaactcgtaaccctgcgcaagaggcttcagcgcgtaagtgtcaacgaagtcgttgaactggaaaatcgggcggttgacgctttcccaagggtcttcttctgttgccgcctgagtggcgaacggcgccagcaacaggccggcacatacacttagctgagcgagcggatagctccagcgcatagaaaaactccttggatttgtactgtcgcggacatcggggcccgggcattaaggtcgctagtataagcgtaaacgccggtttggacagtcggccaattgtgcaaagttgtaggacgcttcccacgccgcgcttcacatagccgtcacgctactgtcacctgcaatgactagccttatcggtatttcagggacgctgccatgactcacgccgaaaccttgcccctcactgcgtccagcctgaccgccgtactgtttggactcagcggctgtctggtggattttggtgctcgcgcccggcaacagacgagcgccttgcccgagcatgccgaggcgacaccgggcgcgctcgacagtctgcacagtttgcagcgccagcagattccctgcgcctggctggatgaactgccccctgccctcgcccaatcgttgtcggcctcactgccggcgtcaatcaaacctgcgcaacattcggcaacactcaatccgtggcctgcgccgaatgcctgctggcaagccctgatggagttgaacgtcgccagtctggacggctgcgtattggtcagcggtgagccgcggctgttgcaggctggcctgaatgccgggctgtggaccatcggcctggcctcctgcggctcgctgtgtggcctggcgccaggtgaatggcaagccttgagccagaaagaacgcgaacacctgcgtggcaaggccaccgtgcaactcttcgggctgggcgtgcattcggtgatcgatcatctgggcgaactcgacacttgcctggcggatatcagcttgcgccggttcaaaggcgaaaagccctgatcgggatcatgcaggtttgccgggagtggattaatctaaaggtcagccatagacctttggcgcgcggctgcggtcaatgccagtgcctattgataaaaggaaaccaccatgcccgcccaagaactgcaaaaacagctcgataccctgcgcgagcagctggagcagaatccgccgctgtcggaagtcgaacgtgaagacctgcatgcgctgatggcgcagattgaatccgaaattcaactggagactgccacacaagacgccagcatcgctgacggcgtcaatctggcggttgatcgctttgaactcgaacacccggccattgccggcaccttgcgcaacatcgtcaacgcgctgggcagcatggggatctgactccccccggaacgcaaaaagccctgccatcactggcagggctttttcatttcaactttggcaatgcattccccgtaggagtgagcctgctcgcgatagcggtgtgtcagttaacatcatcgtctgctgacacaccgctatcgcgagcaggctcactcctacagttgatctttattgacgcacgagccggtggttcggcagctgtacgctttcggtgctgcgatacgggttgatatccagaccgccgcgacgcacgtaacgggcaaataccgtgagcttctcaggtttcagcaaccgctgcagatcgaggaaaatccgctccacacactgctcatggaagtccgagtgctggcggaagctgacgatgtattcgagcagactcgcatgatccagcgccgaaccacggtactccaccacaacgctgccccagtccggctgactggtgaccgggcagttggatttgagcagatggctatacaccgtctcctcgacaacccgcgaatcatcgcaacgcagcaattccgggcgcggatgttcatagttgctgacgctgatatccagatcgtcgatgcatacgcccggcaacgccacaacgccttccgcttcaacgtccttcaggctgcgaacgcgcacccccaccggtttgccggcggcggccgacaaatccttgatcagggtcgcttccagggacgccacgtcggcaaatgccgtttgattcaacgagttcagatacaacttgaacgacttcgactcgatgatgttcggcgagtccgccggaatgctgaattcgccgattgccaccaccggtttgccggatggcagcagccacgacaactcgaagcagttccagaaatccacacctttatacggcagggtttcggcggtcaggcccagctcggcccatttcgcggtgcgcggaatcgggaacagcagggacggcgtgtaagtggcgatgtattcgctggatttgcccagcggcgaatgttcggctgcgggatgcatggcggaaacctgactgaataatcagcggattctaccagcctttgcccgcgcctttgagtgcttactgactgaccgtcagtttgccgaccatacccgcctgataatgcccgggaatattgcaggcaaattccagactggtggccttactgaaggtccaggtcagctcggcggttttacctggctcgaccaacacgctgttcggatcatcgtgcttcatgccatggcccatcgctgcgtgatccatgccggccatatcgtgggacatttccttcataccggtaggcgtgagcatgccgctttgctgcatctgcaacatttcctgctggtgttgggcgtgcatcgccgcgtcaccgaggttgaattcgtgcaacaactggcctttattcaccaagacaaaacgaacggtctcaccggccttgatctgaatggccttgggatcgaaggacatatcgtttagcaccacttcaatgctgcgtgtggcttgggcggcaggcgctggctggccgaaatcgtaggtgtgcgctggcgcggcccacactggcgagctcagcgccaacagacaggcagccaacgtcaaggattggcgtaaaaacatggtcgttctccaacaagataaggttcagcttatgggaaactttagccggcctgcgctggcatctacctgacaggcagattacaactttgtcaggttggcgtttgtcgcctgcgctcacggtataaagctttcgtttctacacccccgaacaaacccgagttgcccatgaaactgttgatcgtcgaagaccaagcgaaaaccggccaatacctgcgccagggcctgaccgaggccgggttcaatacggaactggtggccgacggcaacagcggtcagcaactggcgctgagcggtgattacgcgctgctgatcctcgacgtgatgctgcccggtcgcagcggctggcagattctgcaagcggtgcgcagcgccgggctggatacgccggtactttttctcacggccaaagacgccgtggaagacagggttcatggcctcgaactcggtgccgacgactatctggtcaagcccttcgctttctccgaactgctggcgcgggtgcgcagcctgttgcgtcgcggcagcgctacaacccaggaaaccagtctgcaactggccgatctgcgcctggatctgattcgccgccgcgtcgaacgctccggccaacgcatcgacctgaccgccaaagaatttgcgttattggaaatgctcctgcgtcgccagggagaagtgctgccgaaatcgctgatcgcctcgcaagtctgggacatgaatttcgacagcgacaccaatgtcattgaagtggcgatccgccgtttgcgcctgaaaatcgacgacgagttccccaacaaactgatccacaccgtgcgcggcatgggttacgtgctcgaagagcgtggcgcctgatgcgtcggctgtcattgagctcgcgcctggccttgttgttcgccgcttgcaccgctgtggtttcactgttcgccggggtgctgttcaaccgcgccagcgaagcgcacttcattgaactcgaccagcaacaactggacggcaagctgatcggcctgcgccgcgcgctgcaggatcttcagcctgctcagcgtgaagcgcgactggcagatgagctgagtcgtcaggccgatctgtcactgcgcatcaccggcagtgacggccaacgctggtatgacagttcgcagatccccaaggatttgccgcaacaatccggcctgtcgaccataagccatgacggcaccgattaccgcgtgctcaacgccccgctctaccccgaccaaaccgactcgccgcgattgaccttgctgctggacatcacccatcaccagcatttcctgcaacgcatgcagcatctgatctggctgacggtcgggctgtcagcgctggccacggctttgctcggtgcctgggccgcacgcagcggcttgcgtccgttgcggcgtatgagcgcggttgcccgtgggatttccgcacaatcgctcaacgcccgactgccggaagcgcaaatgccacccgagcttgcggaaatggcccacagcttcaacgccatgctcgcacgcctcgacgactcgtttcagcggctctcggcgttttccgccgacatcgcccatgaactgcgcaccccactgtcgaacctgctgacccacactcaggtcaccctcacccgcccacggccgatcgaggattatcgcgaagccctgcacagcaacctcgaagagctgcaatggatggcgcaactggtcaacgacatgttgtacctggccaaggccgatcacggtttgctgatgcccaagcgtgaaccgctggagctggcggatgaaacggatgtgcttttggagttttttgcgccgctggcggaggacgccggggtcaagctgacgcgcgagggccatgcgcggatcgagggtgatcgcagcatgttgcgccgggccttgtcgaatttgctggataacgcgctgcgctttacccccgctgagggctacgtgagtttgcggatcgttgatcaagcgagcgctgtgcgtatttcagtcgaaaacagtggcgaggggatttcagcgcagttgctaccacgcttgttcgaccgcttttatcgggctgatccggcgcggcaggaaggcagcagtgagcatgcggggttggggttggcgattactcaatccatcatccgcgcccatggtgggcagattcattgcgaatcggaggcgggctggacgcggtttgtgattgagttgcctcgaacctgatcgttcccacgctctgcgtgggaatgcagcccgggacgctccgcgtcccatcctaagccgaacgcggagcgtccgttgaggcattcccacgcagagcgtgggaacgagcatggaaagcggcctgcctgcttaagagtatctcagggcgtgagccggctcgatcttcgccgcccgccaggccggatacaccgtcgccaaaaagctcaggataaagcccgccgagcaaatcaacagcacatccccaccctgcaattccgacggcagattgctgacgaaatacacatcggaactgaagatgtgctgcccgctgactcgctcgatccagcccacgatctgactgacattcagcgcggcgatcacgcccaacacgccgccaataatggtaccgacaatgccgatcaccgtgccctggaccatgaagatcgccatgatctgccgaggcgtggcaccgatggtacgcaggatcgcgatgtcagcgcccttgtcgttcactaccatgatcagggtcgcgatgatgttgaacgccgccaccgcgacgatcatcagcaacagcaggccgatcatggttttttccattttcatcgcgctgaacaggctgccctgggtgtgggtccagtcgtcagccttgaactcggcgcccaaaccggcggcgatgtccgaggagactttcggcgccgcgtacaggtctttgaccgccagacgcacactctgcacctgattcggctgccaatgctgcatggtcgcggcatcagccacgtggatcaggcccatcgagccgtccagttcagcacccaccttgaacacgccgaccacgttcagacgctgcatgcgtggggtgatgccgcccggggcggtgctgacttccgggacgatcagggtgatcttgtcgccaacgttgaggcggaaacgtcgcgcggtgatttcaccaatcaccaccccaaactcgcccggtttcaaggcatccagacgcccctgcacaatgtgctgggcaacgatcgagaccttgccttcctgcgccggatcgacgccgctgatctggatcggctgcatcaagcccttgtaagagagcatgccttccatctcggtgaacggcacggcggcggtcacttctggatttttcatcgcggcggcggccaccggctgccagtcatcgatcggcttgacgccaacgatggttgcgtgcggcaccatgccgaggatgcgcgaactcatttcgcgctggaagccgttcattaccgacaacaccacgatcatcgccagcacgccaagggcgaggccgatcatcgaggtcatcgaaatgaacgaaacgaagcgattgcggcgcttggcgcgggtatagcgcgtgccgataaagatcgataacggtctgaacattcgctggggcaccgtataaaaataaaagacccgacacctttgcaggcgccgggtttcagccaatcagatgggcgtcaggcagccttcttgcaggtgcaatacgcgatccatctggcgggccaggttcatgtcgtgagtcactaccagaaacgcggtgcgcatcgaggtgctgagttccagcatcaaatcctgaatgccctgggcggtgtgggagtcgaggttgccggttggctcgtcgagcatcaccaggcctggcttgttgaccaaggcgcgggcaatcgccacacgttgacgctcgccaccggacagttccgccggtttgtgctccagacgatggccgaggccgacgcgttccagcaatgccgtggcgcgctgacgggcttccgggatcggcgtcttgccgatcagcagcggcatgcagacgttttccagcgcggtgaattccggcagcaagtggtggaactggtaaacgaaaccgagcgcacggttacgcagcaggccacgcttcttctcgctcagcgccgacagttcttcaccgtcgagccagacgctgcccttggttggcgtatcgaggccgccgagcaggttgagcaaagtacttttgcccgaacccgaggtgccgacgatcgccacacgttcgccagggtgcaactccagttgcaggccagccagtacttctaccgattccgggccttcttcataggatttgcccaggttgcggcagctcaggattgcttgttcactcatgcccgactcactcataacgtagcgcctccgccggctgggtgcgcgcggcacgccaggctggatacagggtggcgaggaaactcaggaccaacgcagcggcgcagaccatgacgacatcctggctctgcacctgcgacggaagataatcaatgaaatacacgtcagcattaaggaatttgtggccgatcaggccttccagtgccgagatcgcggcgctgacattaagcgccgcaaaaatgccgactaccgcaccaatcgccgtgccgaccacaccgatcaccgtgccttgcaccatgaacgtgcgcatgatcgtgcccggcgtcgcgcccaaggtgcgcagaatggcgatgtcgcccttcttgtcgttgaccaccatcaccagcgtggaaatgatgttgaacgcagccacggcaacgatcagcaacaacagcaggccgatcatggctttttccatgcggatcgcctgatacagattgccgtgggtgcgcgtccagtcgcgggcgtagtaatggtcttcgccgagttgctgggcgatgttccatgcaacgcgcggtgcctggaacaagtcgtcgaacttcaggcggatgccctgtacctgatcaggcttccagcggtgcatcttcgccagatcctgcaggttggtgacgcccagatagccatcgagttcgccagcgccgacatggaaaatgccgaccacggtgaagcgcttcatgcgcgggaacatgccggccggggtcaggctgacctccggtgcgacgaaggtgaccttgtcaccaatgccgacgccgagcttggtcgccgccttgtcgccgatgacgatgccgaagctgcccggcgtcagatcgtcgagtttgccctgcttcatgaagttgtcgatgatcgacacgttgcgctccagcgccgggtcgatggcattgagcaacaccttggacacctgaccgttattggtcagcaggccctgcatctgggtgaacggcgcaaccgccgtcacctgcgggttctgcttgaccttggtggccaggctttgccaatcgttgatcggttcagtggattcaatggtcgcgtggggcaccatgcccagcacgcgggtgcgcatctcatgatcgaagccattcatcaccgacagcacgacgatcatcacgaccacgccaagggcgagcccgatcatcgaagtcagggaaatgaatgacacaaaatgattgcgacgctttgcacgggtataacgcgtgccgataaatacgaagagaggtctgaacatgtcggggcttgttcggagggaaaaggaacgtccttgtggcgggggtcgataaccagctttacactcagaccaccgccgctaccatgggttcgccatgtcgacattagatgaagaagatcgccgcgaatactaccgtatcgaggacacgatcgcactggaaattcggcccctgtccgctcccgaagccgcaggccaggaagtgttgcaggatgcttccccactgttcaacctgctcagcgaactgcacctgagcgaattcgagtcgcagcacctgttgcgccagatcagcgagcgcgatcgggccatcgcggccttcctgaaatcgcagaacaagcgcattgacctgctcagtcaggtggtcgccctgaccgtgctcggccatatcggcgagccgcaaccggtgatcatctccgagggtggaatcgactttcagtacccgacgccgattgccgccggtgcacacctgtcggtgaaactggtgctgatgccgcaagcgctgggcctgttgctgcgcgcccgtgtcacccattgcgaccgcaagggcgagggttatgacgtcggcaccgagttcgaacacttgaccgatgcccagcgccagttgctcgcccgctatatcttgcagaagcaggcccaggaacgacgtctggcccgcgaacagaacgaatcaggcatttaatttaaggaagaaccgtgaccctcatctacggccaccgcggcgccaagggcgaagcaccggaaaacaccctgagcagctttcaggaatgtctcaagcacggcgtgcgccgttgcgaactcgatctgcacctgtccaaggacggcgagttgatggtcatccacgacccgaccctcaaacgcaccacggaccgccgtggcaaggtcgtcgagcacaccgccgccgaactggtcacctacgacgcgcgcaagggtggcccgggctggatcaagccgtgcccgattccgacgctggaagagttgttcgagcagtgtgatttcgagcactggcaactggaagtcaaaagcgcttcgcgtactcgcgcggcaaccacggtgttggcgattcgtgaaatggctcagcgccacggcctgctcgacaaggtgaccatcacttcgagttcgcgggaagtgctgaaagcggcgctggatctggtgccggatgtgtcgcgggggttggtcgccgaatacgcctggctcgatccgttgaaggtcgcggccagttatggctgtgagattctcgcgttgaactggacgctgtgtacgccggaacgcctgctgaaggcgcagcgtcaggggctgcacgtgtcggtgtggaccgtcaacgaacctgcgctgatgcgcaggctcgccgacttcggcgttgacagcctgattacagactttcccggtttggccactgccaccctcgagaattgctgaaatcggtctccccggccggctcaggccaccggccggagcccgtcaaaaaagccggttaaggccgtcgtacgctgctacccgataggcttcggccatggtcgggtagttgaacgtggtgttgacgaagtacttcagggtattcagctcgcccggctggttcatgatcgcctgaccgatgtggacgatctccgacgcctgataaccgaagcagtgaacgcccagcacttccagggtttcacggtggaacaggatcttcagcatgccttgcggctcgccggcgatctgcgcacgcgccatgctcttgaagaatgccttgccgacttcgtagggcactttggcctgggtcagttcctgctcgttcttgccgatcgagctgatctccggaatcgtgtagatgccggtcggcacgtcattcacgaaacgccagctaccgttatcaacgatgctgccagcggccgaacggccctggtcgtgggcagcactggccaggctcggccagccgatcacgtcaccggcaccatagatgttcggtacgcaggtgcggtaagcctcgtcgacttcgatctggccacggctgttgaccttgacgccgatgttttccagacccaattgatcggtgttaccggtacggccgttgcaccagagcaaggcgtcggccttgatcttcttgcccgacttcaggtgcaggatcacgccgttatcgacaccttcaacgcgatcgtaatcttcgttgtggcgcacagtgatgttgttgttgctgaagtggtagctcaacgcctgggagatttccgagtcgaggaagctcagcaactggccacggttatcgaccagctcaaccaatacacccagaccactgaagatcgacgcatactcgcaaccgatcacgccggcgccgtaaacgatcagtttgcgcggggtgtggccgaggctgaggatggtgtcgctatcgtagatacgcgggtggtggaaatcgatgtccgccgggcgataaggacgcgaaccggtggcgatgatgatgtgcttggccaccagtttctcgaccacgccattggcgcagaccacttcgatggtttgctcgtcagcgaagctgccggtaccgaagaacacgtcgacgcggttacgggcgtagtacccggtgcgcgaagcaacttgtttggaaatgaccttctcggcgcttttcaacacgtccgggaaggagaaccagcgtggctcgccgatcgcccggaacatcggattggtgttgaactgcatgatctgccgcaccgagtgacgcagtgccttggacgggatggtaccgaggtgggtgcagttgccgccgacctggcgacggctgtcgaccatcgcgaccttgcgccctgctttggcggcgttcattgccgcgccttctcccgccgggccggaacccagcaccaccacgtcgtagttgtagacagccatgcgtactcctcagaacaggccgcggtgccagcagcacctacggctaaatcacgccgaacagcggcgcgaaggaacaattgggggtcaatcaagaacccggacacagtctatagaagcgtcaacgccgcgcacattaacccttggtcgcgtcgtaggctacttttgcctgcactacaacgccagctttcgtattgttctcagtcagttttttcgccactgaggcgttcgaaagccttgttggtgcggacgacaaaacctgtatcggcacgaatgacgaagaatgcaccaatgtcatgtttttcggcatagtcccacgccctttccgggccaagaatcagcaacagcgtcgatagtccatcggccatcaacgctgaaggatgaatcactgtgactgacgccaggtcgtgtaggacgggtgcaccgctgcgcgcatcaaaggtgtgggaataacgccggccatcctgcaggaaatagttgcgatagtcgccggacgtggagacgccgtagccatcgacattaatgacgcgttcgacgacctgttgatcatcacggggttcttccaaagcgatgcgccagggtgagccgtcgagttttttgcctttggccttcaattcaccggtggcttcgaccaagtagtcttgaatgcccatggcgtcgagcctcgccgcgatagtgtcgacggcataaccggcagcaatgctgttgaagtcgacttcgacggcggcgtctttgcacaactgatcgccattggcgtgcaagtgctgatgaccaatgcgcgacatcacctcagccagtgcctcggcgtcagggactttctcttcgcgcccttgcgggccgaagccccagagattcatcagcggctccacggtgagatcgtaggaaccttcgctttgcgctgacagttgctcgcccacaaggaccaattccagcaccgaagcaggcattttctgacagctgttcgcgggcaaagcgttgaagcgctcaatgtccgaatcattgcgataagtcgataactgccgatcgacttcgccaaggatgctctccacttcacggcgaacctgcgtcgcgtcaggcatgccggcgtggcgcacgtacttgatcgagtacgtgctgcccatggtcggcccaccgaaaccttccgtggaatcgccattgccgcagccagccaatatgcccgcaagaatcacgagcccaagcaaccgtccagtgaacaattattcatctctccgtaaaaccgcgacggccattatgaattaaaggatctgcaacatctttatacaaaatccaatagtgagacctgaccatgtcctccaccacgggcaaaggcaaagcgatctttcgcgttgtcagcggcaatttcctcgaaatgttcgactttatggtctacggcttttatgccacggccatcgctaaaacgttctttcccaccgacagcgccttcgcctcgctgatgctttcactggcgacttttggcgctggcttcctgatgcgcccactgggggcgattttcctcggcgcctacattgaccgtcatggccgccgccaaggcttgatcatcacgctggcgttgatggctgccggtacggtgctgattgcctgcgttccgggttatgccaccctcggtgtcgccgcacctttgctcgttctgttcggccgactgctgcaaggtttctcggcgggcgtcgaactcggtggcgtgtcggtgtatctggcagaaattgccaccccgggtcgcaagggctttttcgtcagttggcaatccgcgagccagcaagcggcggtcgtcttcgccggcctgctcggcgtcggcctcaatcactggctaagcccggaacaaatgggtgattggggctggcgcgtgccgttcctgatcggctgcatgattgtgccggtgatctttgtcattcgtcgctcactggaagaaaccccggaattccaggcgcggaaacatcgccctaccctgcgggaaattgtccgctcgatcggtcagaactttggcatcgtcatcgccggcatggcgctggtggtgatgaccaccgtgtccttctatctgatcaccgcttacaccccgaccttcggcaaggctgagctgcatctgtcggatctcgatgcgctgctggtgacggtgtgcatcggcctgtcgaactttttctggttgccggtgatgggtgcggtgtccgataaaatcgggagaaagcccctactgcttgcggcgacgattctggcgattcttaccgcctatcctgcgctgtcgtggttggtggcaaatccgagcttcagtcatttgctgattgtcgagctgtggttgtcgttcctgtacggctcgtacaacggcgcgatggtggtggcgctgaccgagatcatgccggtggaagtgcgtacgaccgggttctcgctggcttacagcctggcgacagcgacgttcggcgggtttaccccggcggcgtgtacgtatctgattcatgtgctggataacaaggcagcaccggggatctggctgagtggtgcggcggtattggggttgattgcgacgctggtattgttccgtggcaataaacatgaactgcgcacggcgcaggcggccatacccggcggcgctcgttaaatagctatcgcgagcaggctcactcctacattggatctgtgtcgttcacaaatccccatgtaggagtgagcctgctcgcgatgaggcaggtactgacaacacacttctaaaaggcccacaaacaaaaacgccccgaccaaagtcggggcgttttcatgtgcagctaaggcttagcgcgggaatgccggcggattcacatcagccatgtcttccatcacgcgaaccacctggcagctgtaaccgaactcgttgtcgtaccagacgtacagaacaacgcggttatcctgaacgatggtcgcttcagcgtcgactacaccggcgtggcgcgagccaacgaagtcggtcgaaaccacttcctgcgaattgacgaagtcgatttgcttgtgcagatcggagtgcagcgccatgtagcgcaggtactcgttcatctcttcacgggtggcggctttctcaaggttgaggttgagaatggccatcgacacgtttggcgtcggcacacggatcgcgttaccggtcagcttgccggccagttcaggcagggccttggcagcagcggtggcagcaccggtctcggtgatgaccatgttcagcgcggcgctacgaccacggcgatcgcctttgtggaagttgtcgatcaggttctggtcgttggtgtacgagtgaacggtttcgacgtgaccgttgatgatgccgaacttgtcattcacagccttcagcaccggcacgatggcgttggtggtgcaggaagcggcggacacgatcttgtcttcagcggtgatttcaccgtggttgataccgtgcacgatgttcttcagcttgcctttgccaggcgcggtcagaactacgcggtcgatacccgggcaggccaggtgctgaccgaggccatcggcgtcacgccatacaccggtgttgtccaccagcagcgcgtctttgatgccgtactgggtgtaatccacttcagtcgggttcttcgcgtagatcacctggatcaggttaccgttggcggtgatggtgttgttttcttcgtcgatggtaatggtgccgttgaacgaaccgtgtaccgaatcgcgacgcagcaggctggcgcgtttggtcaggtcgttttcggcgcctttgcgcacgacgatggcacgcagacgcagaccgtcgccaccaccggttttctcgatcaggatgcgcgccagcagacggccgatacgaccgaagccgtacagcacaacgtcggtgcctttacgtgcggaagcgttttgctggccaaccacgtcagccatttcttcacgaacgaattgctcggcgctgcggccattgccttcgttacggaatttgaacgccaacttgcccagatctaccgaagccgcgccgagcttgagctcgctcatggctttgagcagtgggaatgtttcgtggacggagagttcgctgtcgtcggaagaacggtggcgagcaaagcggtgagctttgagaatcgcgatgacagactggttgatcaggctgcggccatagatcgagctcaccacgttgttattgcggtagagctgaccgataagcggaatcatcgcttctgcgagtgcttcacggtcgatccattcaccaagacactggtcgggcttctgagtcacggtaaccttccacatgtaggggcagaaaaaaggggctacattatgccgccgacaacctcattcagcaatgcgcgcttgtcgcgaaatcggtaacaaaattcctttcaaaaaaacaacgcctcgcgccagcccagtaaatacgcggcttccagcgcagtcaatttttcgtcgactgttagacgatgtctgtaaccctccgtaacacgagccaatttcggcactacataaccactaaaaaagtgctcgtttttatggttaccactacatttcgccaaaacagcgaagatagacgtagtctgcaactgacaggcggcaccggacgccgctacaattaccgactttgtcgcaaagcctggagctcaaccttccgtgcccgttctgcgtctaccgcaactccctgccgaggcaggtaaacagcattggggcaatttgcccggtgctgccctcagcctggcgattgccgaggctgccagcgctgccaagcgcttcaccctgctactgaccgccgacagccagagtgctgaacgactggaacaggagctgagtttcttcgccccggatttgcccgttctgcatttccccgactgggaaaccctgccgtacgacctgttctcgccgcaccaggacatcatttcccagcgcatcgccagcttatataggctgcccgagctggaacatggcgtgctggtggtgccgatcaccacggcgttgcaccgcctggcgccgaccaagtttttgctcggcagcagtctggtactggatgtcgggcagaaactcgatgtcgaacagatgcgctcgcggcttgaagccagcggctatcgctacgtcgacacggtgtacgaacacggcgaattcaccgtacgcggcgcgctgatcgacctgttcccgatgggcagcaagctgccctatcgcatcgacctgttcgacgacgaaatcgaaaccctgcgcaccttcgatccggaaaaccagcgctccatcgacaaggtcgaatcggtaaagctgctgccggctcgtgagtttccgctgcagaaagatgcggtcacccgcttcaaggcgcgctttcgcgagcgtttcgacgtcgactttcggcgctgcccgatctttcaggatctgagcagtggcatcactccggccggtatcgagtactacctgccgctgttcttcgacgaaacctcgacgctgttcgattatttgccgcaggacacccaggtgttctcgttgccgggtatcgagcaagcagcggagaatttctggaacgacgtgcgcaatcgttatgaagagcgccgcgtcgatccttcgcgtcctttattgccacccgccgaattgttcctgccggtggaagactgcttcgcgcgcctgaagagctggccacgcgtggtcgccagccagcaagacgtggaaagcggcgtcggtcgtgagcgctttcctgcacaagcactgccgaatctggcgattgaagccaaagccacgcaaccgctggccgcgctttctgccttcctcgatgaattccccggtcgcgtgctgttcaccgccgaatccgccggccgtcgcgaagtgctgctggagttgctggagcgtctgaagctgcgaccgaaaaccgtcgacagctggccggacttcgtcgcgagcaaggatcgcctggcgatcaccattgccccgctcgacgaaggcctgatgctcgacgatccggcgctggcactggtcgcggaaagtccgctgttcggccaacgcgtcatgcagcgtcgccgccgcgagaagcgtgccgacggcaacaacgatgcagtgatcaaaaacctcaccgagctgcgcgaaggcgcgccggtggtgcacatcgaccacggtgtcggccgctatctgggcctgacgattctggaaatcgacaatcaggccgccgaattcctcaccctcgaatacgccgagaacgccaagctttacgtgccggtggccaacctgcatctgatcgcccgttacaccggcagcgacgatgcgctggccccgctgcaccgcctcggctcggaaacctggcagaaagccaaacgcaaggccgccgaacaggtgcgtgacgttgctgccgaactgctcgacatctatgcccgtcgtgctgctcgcgaaggttatgcgttcgccgacccgaaagccgattacgccacattcagcgctggcttcccgttcgaagaaaccccggaccagcaatcgaccatcgaagccgtgcgcgaagacatgctcgcgccgaagccaatggatcgactggtctgtggcgacgtcggtttcggcaagaccgaagtggccatgcgcgcagcgttcatcgctgtgcacggcggtcgccaggtggcgattctggtgccgaccaccctgctcgcccagcagcactacaacagcttccgcgaccgcttcgccgactggccggtgactgtggaagtgatgagccgcttcaagtcggccaaggaagtcaatgcggcgatcgccgatctggcggaaggcaagatcgatattgtcatcggcacgcacaagctgctgtccgacgatgtaaaaatcaaaaacctcgggctggtgatcatcgacgaagaacaccgtttcggtgtgcgtcagaaagaacagctcaaggccctgcgcagcgaagtcgacatcctcacgctgaccgccacaccgattccgcgcacgctgaacatggcggtgtcgggcatgcgcgatctgtcgatcatcgccacgccgccggcgcgacgcctgtcggtgcgcaccttcgtcatggagcagaacaagagcacggtcaaagaggccctgctccgcgaactgctgcgtggcggtcaggtttactacctgcacaacgatgtgaaaaccattgaaaaatgcgccgccgatctcgccgaactggtgccggaagcgcgtatcggcatcggtcacgggcagatgcgcgaacgcgaactcgaacaggtgatgagcgacttctatcacaagcgcttcaacgtgctgatcgcctcgaccatcatcgagaccggtatcgacgtgccaagcgccaacaccatcatcatcgagcgcgccgacaagttcggtctggcgcaactgcaccagttgcgcggtcgtgtcggtcgcagccaccaccaggcgtacgcctacctgctgacgccgccgcgccagcaaatcacttcggatgcggaaaagcgtctggaagcgattgccaacactcaggatctcggcgccggtttcgtgctggcgaccaacgacctggaaatccgtggcgccggtgaactgctcggcgatggtcagagcgggcagattcaggccgtgggcttcacgctgtacatggagatgctcgaacgcgcggtgaagtcgatccgcaaaggcgagcaaccgaacctcgatcaaccgctgggcggtggcccggaggtcaacctgcgagtgccggcgctgattccggaagactatctgccggatgttcacgcgcgtctgattctgtacaagcgcattgcttcggccaccgacgaggaaggcctgaaggatctgcaagtcgagatgatcgaccgtttcggtctgctgccggaaccgacgaaaaatctggtgcgtatcactgcgctgaaattgcaggctgagcaactgggcatcaagaaggtcgatggcgggccgcaaggtgggcgcatcgagttcgaagcacagacgccagtggacccgatgaccctgatcaaactgatccagagccagccaaaacgctacaaattcgaaggcgccacgatgttcaagttccaggtgccgatggaacgcccggaagagcgctttaatactgtagaggcgctgtttgagcgcctcctcccgaaaactgtttgaaggacgccgcatgcgcctgtttcgctcgctgactttgctactcaccttggtagcgcctacggcgtttgccgatgacctgtatcaggtcgagatgattctggttcgccagaacgctgtacaggcgattgtcagccgtgccgccccggaagactgggccgccggcgcccagcgcctggccgaggacagccagcgcacgcctgcgctgaatgacattgtcaccaaactcaccgccagcggcgactacagcgtgctgatgcacaaagcctggcagcaaaccctcggtgaagcgccatcgaaagtcgcggtcagcgacggtcaggagcaatacggccagttcccgatcgagggcacgctggagatgaagctcgggcgtttcaccgacgtcgcggccgatttctgggtcaacaagatcaacaccaacggcctggtcaccgccagtgagcgcctgaaacaggacagccacaccaagaacggccaactcaactatctcgataacggccatctggcgctgctgatcaagatcacttccctgaccgcacctgcgccacgggaagcgcctgaagcgattccggactgatcgaagtccttatgaacccgccgctgagtaaaccgttggcgccctcctgggtcagccgattcaaggaacagagcctggagcgtggccgccgctacgccctggaaaaccgggtacgcatcgcccaggtcggcgatgcaacgatcaccgccagttgcgaaggctctggcggtaacgtttaccgtcagacgattcatcttcgcgagtcagccaaaggcactttgctgctggtcgatgccggctgtacctgcccggttcgcagcaactgcaaacactgcgctgctgtcctgctgaaagtgcaggaaaccctcgattaccctgccgcggccaaagacgccgaattactggagaagctccaagccgtgctggaaaaccgtggcccgaaagcgccaccgcaagtgctggtcgacaacgtgcaacccttgccgcgcctgtggctggccagcgtcgagttcagcgccttcgaaccgcgcaacggcaagatgcagcgttatattcagcaccgcgcggcgttgtcgttcagctatctggatgagtacgtcagcgggcagaagaacagcgacatcctgatccgccaggaaacccagacactgcggataaaacgccacccggacgtcgaacagtcctaccgcgaacagttaagaatcctcggctttcgtatcgccacgcggcagagcaaagccctgccggaaagcgcgggcgagctgtacgagatggtcaatgacagcgcctggctgacgtttaccctcaacgatctgccaaaactacgcagccaaggttgggagctgcagatcgacgaagagttcggcttcgacctgaccgctgtggatgactggtacgccacggtcgagcaggcgccggagcgtgactggttcgatctggaactgggaatcatcgtcaacggcgagcgcttgagtctgctgccgatcctgctcaatctgatgcgctcgcacgcggaaatcctcaatccggaacgccttgcgcgccgtcgcgatgacgagctgattctggtcaatattccgcaacgcaacagcgagcacgggccgctgcaagtggcgttgccgctggggcggttgaaaccggtgctgatgaccctaggcgagttctatttgcaggaaccgggcgaaaccactttgcgcctgagcaaggccgacgccacacgcctgaactcgctggaaggcattccgctcctctgggagggtggcgagcagattcgtacgtttgctcaacgcctgcgcgacattcgtgatttcagcgcgcaagctccagagggcctgaatgcgacgctgcgtccttatcagctcgaaggcttgagctggatgcaatcgttgcggcaactggaggttggcgggatccttgcggatgacatgggtctgggtaaaaccctacagacgcttgcgcatattctcagcgagaaaaacgccgggcgcctcgatcgaccgtgcatggtggtgatgccaaccagcctgattccgaactggctggatgaggcggcgcacttcaccccgcagctgaaagtggtcgcgctgtacggcgccactcgtaaaaaacatttcgataatctggccgatttcgacctgatcctcaccacctacgcgctgctgcccaaggacgtcgaacgtctggccaagcagccgctgcacgtattggtgctggatgaggcgcagtacatcaagaatccgaacagcaaagccgctcaagccgcgcgcgagctgaacgcgcgtcagcgtttgtgcctgagtggtaccccgctggaaaaccacttgggtgaactgtggtcgctgtttcacttcctgctgccaggctggctcggcgacgtaaaaagcttcaacgccgattaccgtgtaccgattgaaaagcgcggcagcgaggtcagacttcagcaccttaacggtcgaataaaaccgtttctactgcgccgcaccaaggaacaggtggccaccgagttgccgccgaaaaccgagatcatccactgggtcgatctcaacgaagcgcaacgcgatgtgtacgaaaccatgcgcctggcgatggacaagaaagtccgcgacgagatcacccgcaaaggcgtggcacgcagccagatcatcattcttgaggcgctgttgaagctgcgtcaggtttgctgtgatttgcgcctggtcaacggcgccaccctgcccgctcgcggcagcacctcgggcaagctcgacagtttgatggaaatgcttgaggagttgttcgaggaaggccggcggattctgctgttttcgcagttcacctcgatgctgtcattgatcgaagacgagctgaaaaaacgtaacgtttcctacgcgttgttgaccggccagacccgcgatcggcgtacaccggtgaaggaattccagagcggcaagcggcagatttttctgatcagcctgaaggctggcggtgtcggcttgaacctgaccgaggcggatacggtgattcactacgatccgtggtggaacccggcgacggaaaatcaggcaaccgaccgtgcttatcggatcggtcaagagaaaccggtattcgtctacaagatgatcgcgcggggcacggtggaagagaagattcagcacctgcagaaggaaaagtccgacttggcggcgggcgtgctggatgggcgcaaggccggggactggaagttgcagagtgatgatattgaagcgctgtttgcgccgctgccggataagtccgacaagcgttgagacctgcgtcgcctgttagatagctttcgctggcaagccagttcccacagacttatgagtcgcacacaaaactgtgattcaactcgatacctgtggagctggcttgccagcgatggggccaactcggtctcggtcagcttcagcccttgagcacccgcgccaacgccgatttcaccttacccatcccgtcatgcaacgcctgctcgatttcggccatggtgatcacttccgtggtcttgcccgccgccgggttcactaccagcgccagacaggcgtaatccagatccagctcacgcgccagcgccgcttccggcataccggtcatgccgacgatgtcgcagccatcacgctcaagacgcacgatctccgccacggtttccagacgcgggccctgggtgcaggcatacacgccttgatcactgtattcacagccttcggcagccaccgcagctatcaattgctgacgcaacggttcgctgtaaggaaagctgaagtcgatgtgggtgacatgctccagatcatcggcgaaaaaagtgtgctcacggccgctggtgtagtcgacgatctggtgcggcacgcagaaatgcccggtacccatggccgaatgaatcccgcccacggcattcaccgcgatgatcgcttcggcgccggcctgtttcaacgcccacagattggcgcggtagttgaccttgtgcggcgggaagcgatgcgggtggccgtgacgggcgaggaacaacacttccttgccggcgtactcgccaatctgcacgtcggccgatggcgcgccgtagggcgtgtccaccgccagcgattggcgaatggtcaagccttcgagctgggtcaggccagtgccgccgatgattgcgtaaaccgtcatagcgaaaaatccttaatcgatcagttgagcgtctttgagcgcgccgatggcggtgagccaacgcggatcctgacggtaatcggtgctggcgaatgcctgaccacgcatgcgagcgatccgctcggaaggcttgaccttcatgcgctgagcagcgctcaaagccagttcggcagcggcgcggtcgttgcacaccagacccatgtcgcagccagcagtcagcgcggcttcgatacggctggcggcgtcgccgaccacatgggcgccagccatcgacaggtcgtcgctgaagatcacgccgtcgaactgcaactcgccgcgcagaatgtcctgcaaccagcgccgggagaaaccggcgggctgcgaatcaacctgcggatagataacgtgcgccggcatgatcgcagccagttgcctgctgagtctggcgaagggcacgaggtcgttggcgcgaatttcgtcgaggctgcgctcgtcattcgggatcgcaacgtgggaatcggcttcggcccagccatgaccgggaaagtgcttgccggtggccgccatgcccgcgctgttcataccgcgaataaacgcgccagcgagcaacgctgcgcgctccggatcaccctcgaaagaacgcgtgccgacgacggcgctgcgctggtaatccagatcgagcacaggggcgaaactcaggtccaggccgacggccagcacttcggtagccatgatccagccgcattgctcggcgaggtactcggcattcggattgtcggcaatggcgcgcatcgctggcaggcgtacgaagccctgacgcaggcgttgcacacgaccgccctcttgatccacggccaacagcaaatccgggcgaatcgcgcggatcgcggcgctgagctcacgcacctggcgtggatgctcaatgttgcgcgcaaagatgatcagaccgcccacttcgggctgacgcaacaattggcgatcttcagccgtcagccaggtaccggcgacgtccaccatcaacgagccttgcaggccagcagtcatagagattccttgaaaacgaaaaacccgatccgcacgaaatcgcccccgggggcattgcccggcaggtcggcgatatctgtgaagatcgggttcagaacgagagtcggcatgggcggctagcttagcggatacaagcagccgcgcccacccgtacgcggttaaaccttggcggcgaccggcgttgatttgctgcgcggacgcagttgcgcagtggccatcgccgtatcggtgacgccggtttcagcgcgcatgccagcggcgaggaacggcaccatcaggcgcatgacttgttcgatggaggtattgacgccgaaatcggtctcggcaatcgcacgcagcgccttgatgccggacatgctgaacgccgcggcgccgagcatgaagtgcacgcgccagaacagctcgatcggcgggatgcgcggcgcagcttcgttgaccagcaacatgtagcgacggaataccttgccgtacatgtcttccagataacggcgcaagtggccttggctctggctgaacgcgagaccgagcaaacgcatgaagatcgacagatcattgccgctacgcggctgaaccacaagggcttgctcgacgaggatctccaacagttcttcaagcgtcggcttgttttcaggcttggcctgacgacgctccagctctttatcgaggctgatacagaacggcccgaggaagcgcgaaaaaaccgcctgaatcagcgccttcttcgagccgaagtgatagttaaccgctgccaggttgacgccagccttgctggtgatcaaacgcaatgaggtttcagcgaaacctttctccgcgaacaactgctcggcagcatcaagaatgcgttcaacggtttccgactgggccatggctactccgcctgacaaacacttgtttgaaacatacgtttcagcctgtgccttgtcaagcctgccggttcgttttgggaatggtcggtcagctatttaaccacacaagacccgcgcattagtaagcaaggctgccgaccgtccggcggcctgcaaaaaaacgggcattgccaagaccgcttcactgtatataatcccagtcactgtataaaaagacagagcgatcaatatgctaaagctgacgccacgccaagccgagattctggcctttatcaaacgttgcctcgaagacaatggctacccgccaacccgtgcggaaatcgctcaggaactgggtttcaaatcgcccaatgctgctgaagaacacctcaaggccctggcccgcaaaggtgcgatcgagatgaccccaggcgcctcgcggggcattcgtattccgggcttcgaagccaaggctgacgactccactctgccgatcattggccgtgtcgccgccggtgcgcccatcctcgcccaacagcacatcgaagaatcctgcaacatcaatccagccttctttcatccgcgcgccgactatctgctgcgcgttcacggtatgagcatgaaggacataggcattttcgacggcgatttgctggcggtgcacaccacccgcgaagtacgcaacggccaggtcgtcgttgcacgcatcggcgatgaagtgaccgtcaaacgcttcaagcgtgaaggcagcaaggtctggctgattgccgaaaaccccgaattcgcccctatcgaagtcgacctgaaagatcaggaactggtgatcgaaggcttgagtgtcggcgtcatccgccgctaaaggaggctttatgcagttcccacacacacctcagcaaacacaactgcctttattcgaagcgtttctggcgcaaccgatggcgccgaccctgaaagaagtggtcgaacgtccgtggaatgccgaacctgaagtattcagtgagctgtcactgcgcggtgcggccggaaactgcctgaacctgcttgccccgatcctccgcgagttgagcgaagatcaggacgcacgctggctgacgctgattgcgccaccggcgagtctcacgcaaacctggctgcgggatgccggcctgaatcgtgagcgtattctactgctgcaaccgcgaggcactcagagcgcacagcaactggcatgcgaagcgttgcgcctgggccgcagccacacagtggtaacctggctcaacccgttgaacagcagttcacgccaacaactgatcaacgctgcacgtacgggcgacgctcaaagcctgaatattcgcttgggttgattagctggtaaaaagcgctgagtgaagcgcagggcttctccagggacagagaagccgatctgaagcgacaatgacaaaaaactgaaaacaggcagggatcaatgaagaacccgcggcccctcgtccttatcaaattcgccttcaatcattcgacctgccatctgcacgccgacgctcaacatcgccttcgcgatttccacgtgctggccctgcaggaaggttttggcatcctcggagaaatccagagtcaccagagaaccttcgtcctcagccctgcgcagttcgattcggccgtctggtaactcgacaatttctagaaaggacgttggcatataggtctgttctccacgaaaggcagggattatatagacatcattcaggcttcgctcgggatcttgaccagcagcatgtttcagattgccaccgagtcaatccccatcagcactcgttcaagccttcgcgaaaccggagagccaagcctttaaggttttgccgccagctttccaactcctctcggctcaactcttcagacgcctcttcttcgtcaaggttaacggcctgaatcaatggctgagttacatcgccttttggcttatggggcacgcgaggcggttgaaacatcgccgaatgcgccgccagcagttttgccagccacgtttccgagttgcctgccaactcgatcatttccgccagctccgggattgcgatcgactccagcacttcgcgcgtcagcagcaactctgcgcgtggcgcattggcttgtggcaggcggtagaaaccggcaatttcatggcaaagacccaacaaggcgccgtagaggtgaaacaacgcggattcgcgcccggcctgaatcagcgccagagaattcatcgcccgcccctcttctgcgcgagccaaagcttccagcgacaggccggcaaaatagatcttctggttggtacgggtatagagttcgtgggccatgaaggcagtctccactacgaaataattgcttcacacaggccgcacagtgtcatggatcagtcgatcccaccgcaagcacaaaacaaaaaggccgcatgaaaacccgagggtgttcatgcggcctttcagtatcaggctaatgcttactcagctttggccttcgtacgcttgtcttcaaccgtccacttgccgccgtcgtaataagccttccaaccggtaggtttgccatcgacttcggtctgcacgtattgctccttggtcttgcggctgtagcggatgaccgcaggcagaccatcaggatccttctgcggtgcttcgcacaggaagtgatacttcggatcaatctcgcccttgtgcggcagaatctcgatcaccaacggagcacgtgtctcgcggtttttcgggaactgactggccgcgaggaacaaaccagaggctccgtcgcgcaggatgtaggtgtcgttgaccttttcgcatttcagctcgggcatcttcaccggatccatcttcggcggcgctgcgtcaccactcttcagcagcttgcgagtgttcttgcaggtcggattggtgcaaccgaaaaacttgccgaaacgaccggtcttgagttgcatctcactgccgcacttgtcgcactccagactcggaccttcatagcccttgatgcgatagctgccctcttcgatttcgtagcccgcgcaatccgggttgttaccgcagatgtgcagcttgcgcttctcgtcgagcaggtaagcgtccatcgccgtgctacagatcgggcaacgatgcttgccacgcagtaccaaagattccgattcaccttcgtcgtccgcagcgatttcatcgcccggcaccaggttgacggtggccttgcagcgctctttcggtggcaggctgtaacccgagcaaccaaggaacacgccggtcgatgcggtacgaatctgcatcggacgaccacaggtggtgcacggaatgtcagtcatcaccggctggttggcacgcatgccgttgtccggattctccgcaacttcgagtttctttttgaagtcgccgtagaactcgtccagcacgcttttccagtcgcgctcgccctgcgccacatcatcgagattctcttccatgccggcggtgaagccgtagtccatcaggttcgagaagctttcagagagacgctcggtaacgatatcgcccatcttttccgaatagaaacgacggttatgcagggtcacgtagccgcgatcctgaatggtcgaaatgatcgctgcataagtcgaaggacgaccaataccgcgtttttccatttctttcaccaggctggcttccgagtaacgggccggcggtttggtgaagtgctgggacggatcgagcttgatcagcttcatcacgtcgccctgcgccatatcaggcagaacgtcgtcatcgcccggcttggcaatctgcggcatgacgcgggtgtaaccgtcgaacttgaggatacggcctttggcacgcagctcgaaatcgccagcaccgacgctgacagtggtggacaggtattgcgccggcagcatctggcaagcgaggaactggcgccagatcagctcgtagagccgttcagcgtcacgctccatgcccgccagcttgcttggaatggtgttggcgtcagaaggacgaatcgcttcgtgagcctcttgtgcgccttccttgctgctgtagacgttcggcgtttccggcaggtacttcttgccgaactcgtcttcgatataggcacgcgccatcgtcacggcatcggccgagaggttggtcgagtcggtacgcatataggtgatgtagccggcttcgtacagacgctgggccatcatcatggttttcttcacaccgaagcccaggcggttacttgcagcctgttgcagagtcgaggtgatgaacggagccgaaggcttgctgctggtcggcttgtcttcgcgtttgacgatgctgtagctggaagccttgagcttctccagcgcggccgtggcctgggcttcgttgagcggcttgaaggcttcgcctttttcgcgagccacttcgaaacgcacggtcgagcctttggcggtgccgagatcggcatgcacttcccagtactcttccgggttgaacgcacgaatttcgcgctcacgctcaacgaccagctttacggctaccgattgcacgcgaccggcggacaggccacgggcaatcttcgcccaaagcagcggcgagaccatgtaaccgacaacgcggtcaaggaaacgacgtgcctgttgagcgttgacacgatcaatgtccaactcgcccggcttggagaacgcttcctgaatcgccttcttggtgatctcgttgaacaccacgcgcttgtaacggctgtcgtcaccaccgatggcttcgcgcaggtgccaggcaatggcttccccctcgcgatccaagtcggttgcgagatagatggtgtcagcatctttggcgagccggcgcagctcttcgatgaccttctctttgcccgggaggatctcgtacttggctttccagccatgatcgggatcgacacccatacgcgagaccagttgcttgcgcgctttctctttcggcgagagcaccggaccttcgcccgcagcagccttgccgcgcttggcggctggctctttgctggcgctagccgaaccgctggtgggcaggtctcggatatggccgatactcgacttcaccacgtattggttacccagatacttgttgatggtcttggccttagccggggattccacaatgaccagcgatttgcccatggatcagaaaattcctgaattctagaagtgaaaggcggttggcgcctgacgcggcaccgctatatatagttgatacaaggtgaggtcaagcacagggttctgtgcgcactcgccttatgccttggaaaaaaggcttggctcggcttgcaccaaagcaaagcgtggcacctgctcgccgtcaacctcgactgactcgaggaacatgctcagagggcgcacccaaaagccgtattccccatacagggcttggtaaaacaccacttcttcttcggtctctgaatgccgcgccacactgaatacgcggtactgcggacctttgtaatgttggtagagcccaggttgtatcggcatgtgatggcgctcactcaaattttttcaaaataaaaacaaaataaatccacaaaaacaaaaaccggggcacttggccccggcttccatcaacgagacgcttagacgcgttcgaagacggtagagatgccttggccaagaccaatgcacatagtggccaccccgaaggtgccgctattctgcttcatcacgttcagcaaggtgccggaaatacgggcaccggagcaaccgaacgggtgaccgagggcgatcgcgccgccgtgcaggttaaccttctcgttcatcttgtcgagcactttcagatctttcagcactggcagggcctgtgcggcgaaagcttcgttgagctcgaagaagtcgatatcgttgatgccaagacccgcgcgtttcagcgctttttgtgtcgccggaactggaccatagcccatgattgccggatccacacccgccactgccatcgaacggataaccgccattggctggatacccagatcctgtgcacgttgcgccgacatcacgatcatgcacgaagcaccatcggtgatctgcgacgaagtaccggcagtcacggtgccgccctttggattgaaggcaggcttgagggccgccagactttccagggtggtttccggacgaatggtttcgtcgtagtcgaacagtttcaggaaaccgttctcgtcgtagccctgcatcgggatgatttcgtctttgaacttgccttccacagtagccttgtgggccaactggtgggaacgcacgccgaaagcatcttgctgctcgcgagtgatgccgtgcattttgccgagcatttcagcggtcaggcccatcatgcccgaggcttttgccgcgtacagcgacatgtgcgggttcggatcgacaccgtgcatcatgctcacgtgacccatatgctcgacgccgccaaccacgaacacgtcaccgttgccggtcatgatcgcttgcgcagcagtgtgcaaagcactcatcgacgagccacacagacggctgacggtctgaccggccgaggtgtgcgggatctgggtcatcagcgacgccatgcgcgcgatgttccagccctgctccagggtctggttgacgcagccccagatcacgtcctcgacttcagcaggatcgaccttggcgttgcgttccagcaatttgctgatcaggtgcgcagacatgtcttcggcgcgggtgttgcggtgcatgccgcccttggagcggcccatcggagtacgaccgaagtcgacaatcacgacgtctctaggattcaagctcataagttcactctcactctagttgggggcgcttaaccgaagaagctctggccgtttttagccatttcacgcagcttcgcggtcgggtggtacagcgcgcccaaatcagcgtactggtcagccagggcaacgaactcggcaacaccgatcgagtcgatgtagcgcagcgcaccgccacggaatggagggaaaccgataccgtagaccagacccatgtcggcttcggcggcagtttcaacaatgccgtcttccaggcaacgcacggtttccaggcacagcgggatcatcatccagttgatgatgtcttcgtcagtgacttcgcgctgctcgtaaacgatcggcttgagcacttccagtaccgacggatcggcaactttcttctgcttgcctttcttgtcggcctcgtaggcgtagaagcccttgccgttcttctgacccaggcgcttggcttcgtacagcacgtcgatggccgaacgacggtcatccttcatgcgatccgggaagccttcagccattacgtcacgaccatggtgaccggtgtcgataccgaccacgtccatcaggtatgccgggcccatcggccagccgaatttttccatgaccttgtcgatacggacgaagtcgacaccggcgctgaccagcttggcgaaaccgccgaagtacgggaacaggacgcggttgaccaggaagcccgggcagtcgttgacgacgatcgggttcttgcccattttcttggcgtaggccacggtggtggcaaccgccagctcactcgacttctcgccacggatcacttcaaccagcggcatcatgtgcaccgggttgaagaagtgcataccgacgaagttttccggacgcttgagggccttggccagcaaactgatagaaattgtcgaggtgttggacgcgaggattgtgtcctctttgacctgaccttcgacttcagccagtacggcttgcttgaccttcgggttctcgaccacagcttcgaccaccagatcgacgtgaccgaagtcgccgtaggacagggtcggacgaatggcgttgagcacttcagccattttcgccgcggtcatgcggcctttatcaacgcggccaaccagcagtttggcggcttcggccagcccctgctcgataccgtgctcgttgatgtccttcatcaggatcggcgtgcctttggaggccgactgataagcgataccgccacccatgatgccggcgccgagtacagcggcctgcttcacgtctttggcgatttcgtcataagccttggcctttttcttcagctcctgatcgttcaggaacagaccgatcaagctctgcgcggcagaggtcttggccagtttgacgaaaccggcggcttcgacttccagcgccttgtcacgaccgaagttcgcggctttctggatggtcttgatcgcttcaaccggtgccgggtagttcgggccagcttgccctgccacgaaacctttggcggtttcgaaagccatcatttgttcaatggcgttcagcttgagtttttcaagttttggctgacgcttggccttgaagtcaaactcgccggagatggcgcgcttgatcagttcgagggcagcttcctgcagtttctctggagcaaccacggcgtcgacggcgctgactttcagagcgtcttcagggcggttttccttgccggcggcaatccattcgatggcgttgtcgacaccaatcagacgcggcagacgcaccgtaccgccgaagcctgggtagatgcccagtttgacttccggcagaccgatcttggctttggtcgacatgacgcgatagtcagccgccaggcacatttccagaccgccgcccaaagcgatgccattgatggccgctacagtcggaacattgaggtcttcgaaatcgctgaagatcttgttggcttcgagattgccagcaaccagctcggcatccggcagcttgaagttctcgacaaattcggtgatgtcggcgccgacgatgaacacgtccttgccactgctgacgatcacgcccttgatcgaagcatctgccttgatggtgtctacggcctgacgcagctcgttcagggttagacggttgaacttgttgacggactcacccttgaggtcgaatttcaattcgacaatgccactttcaagagctttaaccgtgatggctttaccttcgtaaatcatcaactgatctccacgatatggaagctgaacagtacacgtcggacgcaggcgaatggctcggcaggacgctttttcgtcgatgctaacgccaatccacccggcacacccgccaacgcgatagtcgggattctgtaggagcagtctgtaagacaaacgctcaattcatacgcccgtttgatttgggtacgtcaccttcacggaatttccgacaattgtcaatcgcccaaaatacgggttgaaaagcgactttgcggtcatttctgtaagacgaagacccgcaacacgcatctgcatgtaaagtcattcatagaatcaatagttagaaaagtcgccctaattcgccgcagctattgtttaaagggctacgctggagtgactacacggagatgtcgctgaccgagtcaacatgaaaagagtttccggcctgcctggccaaccccgcccgatgaatcatgtcgggctttttattgcgcgtctgccggacgtttcacaccgttgcagtgcgaaaagtccgcgcgtcatgccagcgctttcagagtggcgtcgatatcctgcaaaaccgtggcttcgcccttctcgccccaatacagagcgatcatctgcttgtccgcctcgactttgaaaacattgcccggcaacttttcgaaatgattgagcagcgtttgatcctcgcagacttcctgccactgattgacccatacacccggcgatttctgccagtaaatccagcagacaggctgcttgctccgacgtggccgatgatactgcgcacaaggattcggtggctcttgcgccagccagtgcggccattcctgaggcgccagctgcatggccaggccgatgcgccgcgcctccatacgcagggcgattcgaccgctttgcgcgcgcgatggacgcaaccacgccagcggacttaaaaccaccagcaggattgacaccactaaccagaccgtcatatctctattcccaattctcggtgagcgcattgtgtcactttggaaccaatccgcttgaaaccagccatacttaacaatattgaaacctcacgaggagcacctcatgccctaccaccacatcctggtcgctgtagatctgaccgaagagtgcgaccctgtgatccaccgcgcccgcgagctttccgtgagcaatggcgccaagctgtcgctggtgcatattgtcgaaccgatggccatggcgttcggcggcgacgtgccgatggatctgtcacaactgcaacaacagcagtttgatcaggccaaggagcgcctggagcgtttgaagctcaagtactccgaactcgaaggcgccaactgccacctgacttatggccagccacgccaggaaatccatcatttcgccaaggaacaagcgtgcgatctgatcgtggtcggcagtcatggtcgtcacggcctggccttgctgctcggctcgaccgccaacgacgtgctgcacggcgcgccatgcgatgtattggcagtacacctggtcaaacgttgaaacaccgttccatgtaggagtgagcctgctcgcgatagcgttctgacagtcgacgaatccgttgaatgccaaaccgctatcgcgagcaggctcactcctacgagggagctgcgtttacatatgaaaagcccggcgttcatcactgaacgccgggctttttcacatcaggatcaatcaggcatccagctcggcccaacgctccaccaacgcatccagttcaacctgtaactgctccagcgaagcaattactttggccgtttcagctgcaggacgctgatagaaacctgcgtcagccatttcagcttccacggcagcgatctgctgttccttggcgtcgatatcgcccggcaacgcttccagctcgcgttgcagcttgtagctcaacttcttctttgcggccggggctgcggcggcaggcgctgcaacgactgctggctcggcagtgaccaccgccgaattcagatcagccttgcccgacttactttcagtcacgcccagcagacgcggcgagccgccctgacggatccagtcctgataaccaccgacgtactcacgcaccttgccttcgccttcgaagaccagcgtgctggtcaccacgttgtcgaggaatgcccggtcgtggctgaccatcagcacggtaccgttgaaggtcagcagcacttcttcgagcagttccagcgtttccacgtcgaggtcgttggtcggttcgtcgagcaccagcaggttcgccggtttgctgaacagtttggccagcaacagacgtgcacgctcgccacccgacagcgccttgaccggcgtgcgggcacgctgcggactgaacaggaagtcaccgaggtagctgagaacgtggcggctctgaccgtcgatatcgatgaagtcgcgaccttcggcgacgttgtcgatcacggttttttccagatccagctgatgacgcaactggtcgaaatacgccacgtcgatccgtgtgccctcctccactttgccgctggtcggttgcagaccgctgagcatcagtttcagcagggtggtcttgccggtaccgttggcgccgagcagaccaatccggtcgccgcgcgtcagtaccatcgagaaatccttgatcaggaacgggccgcccgggtgagcgaaactcacgttctcgagcaccatcacctgcttgcccgacttgtcggcagtgtccagctgaatgttggccttgccagtgcgctcacgacgctcgctacgctcgacgcgcaacgctttcagggcgcgaacacgaccttcgttacgggtgcgacgggccttgatgccctggcggatccagacttcttcctgggccagtttcttgtcgaacagcgcgttggcggtttcttcagcggccagcgcggcttctttgtgcacgaggaagctggcgtaatcgccgttccagtcgatcaggccgccgcgatccagttcgagaatgcgcgtcgcgaggttttgcaggaaggaacggtcgtgcgtgatgaacagcacggcgccctggaaatctttcagtgcttcttcgagccaggcaatcgcaccgatgtccaggtggttggtcggttcgtcgagcagcagcagatccggttcggacaccagcgcctgcgccagcagcacgcgccgacgccagccgccggacaactgggcgagggtcttgtcggccggcagttgcaagcggctcaaggtgctttcgaccagagtctgcaaacgccagccatcacgggcctcgagatcttgctgaacgtgcatcagcttgttcaggtcttcttcagtgacgcagttctgcgcgaggtgatggtactcggcgagcaacgcgcccacgccatcaaggccttcagcgaccacgtcgaacaccgtccgatcgtcggccactggcaattcttgcggcaattcgccgattttcagaccgggggcacgccacaccgagccgtcatcgggcttctggtcgcccttgaccagtttcatcatgctggacttgccagtgccgttgcggccgatgatgcacacccgctcaccacgggcgatctgccaggacaccttgtccaacaacggcatagcgccgaacgcaagggacacatcgctgaatttgagcagggtcatgagcttctccaaaaaccgggcgcgcattctacctgagttagggcttcagcaggccggcaatttgtctgtcgaagcactctgcacaacaattgttgcgaacttgtgctgcgaggccggcaaagctttcgccgcttgctggcaaaaggctaagctacagacaattcagtgctgattcgtgtcggcacttgtcatgatttctctgcccggatgtctcatgcgcagtcgccttttcagtgttttgtcctgtttgctacttaccgccgctgccgctcaatccgcccaggcggtggacctgtccacccaacgccagtattacgatgaagccaagcgtgcgctggccaaaggcgatactggcccgtatttccgttacagtcaggcgctggccgattatccgctggaaccgtacctggcctacgacgaactgaccgcgcgcctgaaaaccgcaagcaacgcggagatcgaaaaattcctcgccgagcacggtgacctgccccaggccaactggatgaagttgcgctggttgcgctggctcgccgaccgtggcgactgggcaaccttcgtcagatactacgatccgaaactcaacttcaccgaactggactgcctcaacgcgcagtaccagatcacccacgacaagaaagccgaaggttatgccaatgccgaaaagctctggctgaccggtaaatcgcaacccgccgcgtgtgacgcgttgttcggcatttgggccgctgatggccaactgactgaacagaagcgctgggagcgcaccaagctcgctgctcaggcgcgcaactatccgctggcaaacagcctggtcaacggtttgaccaccctcgccccgcgcggtcgcttgttggttgatgtggcgcaaaaaccggagctgctcaatcagccatcgcgctttaccccggccgacgaaccgatgtccgacgtggtcagcctcggcctgcgccgcctcgcccgtcaggatccggacaaggccatggcaatgctggacggatacgccagcagcatgcatttctcccgcgatgagaaagtcgcgatcgctcgggaaatcggcctgaccctggcccggcgtttcgacagtcgcgcgctggacgtgatgaccaagtatgaccccgagctgcgtgacaacacggtttccgaatggcgcctgcgcctgctgttgcgtctggctcgctgggacgacgcctatcaactgaccaagcgtctgccgcaagacctcgccaccaccaaccgctggcgctactggcaggcgcgcagtctggaactggcgcagccacagaaccccgaggcgcaaaccctgtacaaaaacctcgcgcgcgagcgtgatttctacggtttcctcgccgctgaccgctcgcaatcgccgtactcgctgaacaacaagccattgatgctcagccaggcgctgatcaacaaggtgcgcaacaccccgggcgtccgccgtgcgctggaattccatgctcgcgggcagatcgtcgacggtcgccgcgagtggtatcacgtcagccgccatttcaaccgcgatgagatggttgcccaagcaaaactcgcttatgacctgaaatggtacttcccggcgatccgcaccatcagtcaggcgcagtactgggacgatctggatattcgtttcccgatggcccaccgcgacaccctcgtgcgtgaagccaaggtacgcggcctgcactcgagctgggtgtttgccatcacccgccaggaaagcgccttcatggacgacgcgcgctccggcgtcggtgccagcggcctgatgcaactgatgcccggcaccgccaaggaaaccgcgcgcaagttcagcatcccgctggcctcgccgcagcaagtgctcgatccggacaaaaacatccagctcggcgccgcttacctgagccaggtgcacagccagttcaacggcaaccgcgtcctcgcctccgctgcctacaacgccggccccggtcgcgtacgccaatggctgcgtggcgctgaccacctgagtttcgacgtctgggtggaaagcatcccgttcgacgaaacccgccagtacgtgcagaacgtgttgtcgtactcggtgatctacggccagaaactcaactcgccacagccgctggtggattggcacgaacgctacttcgatgatcaatgacctgtaggagctgccgcaggctgcgatcttttgatcctgcttataaaaatgcccgcattttcatgcgggcatttttagatcaaaagatcgcagcctgcggcagctcctacaggtgcctatagaccgatcatcccccgatgcaagcaatccccatcagagttgatcagccgtgacttttccatcattgaactgcaacgccgccaaccgtgcatacagcggattgctggcaatcaactcctgatgagtaccaatggccacaagtttgccctgatccatcaccgcaatccggtcagcgtttttcaccgtggccagtcgatgcgcgatcaccagggtagtgcgattctgcatcagactcggcagcgcttcctgaatcaggtgttcgctctgtgcatcgagggcgctggtggcttcgtccagcagcaggatcggtgcgtcgaccagcaacgcccgggcaatcgccagacgctgacgctgaccaccggaaagaccgagaccaccatcgccgagatgggtctggtaaccgttgggcatgttttcgataaaatcgtgggcgtgagcaatctttgcggcttccttgacctgcgccagcgtcgccccggggttaccgtaacgaatattctcttcaacgctgccgaaaaacagcgccggcgactgtgacaccaaagcgaaatggcggcgcaaatccagcggatcaagacgggtcaacggcacaccatcaatgaggatctgcccctccagcgggtcgtaaaaacgcaacagcaagtcatataccgtggacttaccggcgccagacggcccgaccagtgccagtgtctcaccagcccgaatggtcagattcaagccattgaccgcgtagctttcaggacgcgaggggtaggaaaagcgcacgtcctgcaattgcagctcgcctcgcacgcgctgcggcaaggtcaccagcccggtggtgggtggctggatgatgttttccgaaccgagcagttccgcgatgcgctcagcggcccctgctgctcgctgcagttcgccaatcacctcgctcaaggtgccaatggcactgccaacaatcaggctgtaaaagacaaacgccgccagttcgccaccggtgatgcgtccggcgatcacgtccatgccgccgacccacaacatcaccgccaccgcgccgagcaccagcacgatcaccatggtgatcatccacgagcgctggaagatgcgtttgcgcgccgtgtcgaaagcgtcctcgaccgttgtcgcaaaacggcgctcatcctggacctggtggttgtaggcctgcacggttttgatctggccaagggtttccgagacatagctgccgatatcagcaacgcggtcctggctcaaacgcgacagattgcgcacgcgtcggccgaaaatcaggatcggcgcaaccacgaacggtaaggcaatcaccacgatgctggtgagtttcgcgttggtcacgaacaacagaatgacaccgccgataaccatcagcaggttgcgcaggaacatcgacagcgatgagccgatcaccgattgcaggagtgtcgtgtcggcggtcagccgcgactggatctccgaactgcggttgttctcatagaagccggggtgcagataaaccagatggttgaacacctcgcggcgaatatcggccacgcaacgctcgccgatccacgacacccagtaaaaccgcgcgaacgtgccgaccgccaggcccagcaccatcaacatgaagatgccgatactctggttgagctgatgcggcgactgggtcatgaagccgcggtcgaccaacaatttgatcccctgccccatcgacaacgtgacggcagcagtgacgatcaacgccagcagcgcaccgatgacctgccagcggtaaggggccagaaatcggctggtcagacgcagggcgcgccggtgcctggaagaaagcttcggggtcattcaggtacacatccgtgttgatgaaagggctagcctaaaccttcttggggcggaactctgtaaatcacaatgagtcaggttaaatatgcccccaaagactaggccatagttgctattggtctaatggccgggttgagacgagcggtcatttctgttggagtggagttgccaccatcgacagaccgcagggagttgtcacagcccggtcacgtggcggttttaacttaggcgtacaacctgatgaggagacaggccatgtccttgcaacacagcagcgatgacaagattgaagtgatccgcaccaaacccggccagactctgggttgctcgattatcgataaggatgggcgcgaagtaccgatcactgaagacatgatccaggacgcctgccgcgaactggagaagcgattggtcaagcctgccgaacaagagtgatatagccaccgtcttcctgacccggcccctttggccgggttttttctgtctgcagatcaggtatttgtggcgcggccttcgcgagcaggctcgctcccacatggacctctgaagatctcctgtgggagcgagcctgctcgcgaaagggccgacccggtttctagacggccaccgcccccagcgccgccacgatcttcgccaacgccggcgaatgcccttcaatccgcaccttcagcccttcaatctcacgccgcaccggatactgcttgcgcaacacatcaaacgccgcacgctgctcgccgacattacctacaaggctgcggcgaaaatccgcatcatcgcggcgcgggtcgtacacgccacggcacaacatcgccagtgcccaggccggatcgctctcgccgtttagggtaacttccgacaaccacggtgctggcagcaagtcactgagctggatgctcgcgggctgaccgataaattcacagtacgcctgatagatctgcgccgtgccgcgctgtttgccatcgaggctgtaaccggcgatgtgcggtgtggccaatacgcagagctctgccagcgcgacgtcgacttcaggttcggcttcccagacatcgagcaccgcttgcaggtcttcacgctccagcaggacattgcgcagcgcagcgttatcgaccaccggaccacgggccgcgttgatcagccaggcgcccggtttgagttgctgtaaacgttgctgatcaaacagatgccaggtcgcgccatcaccgctacgggtcagcggtgtgtgcagactgatcacatcgcactgttcgatcacctcttcaaggctgacgtaatcaccgccctcggcagcctgacgcggcggatcgcagactttcacattccagcccaggcccttcaagacctggatcagtcgaccgcccacttcaccggcgccgataacgccgtaggtgcgtcgcgtcagatcgacgccttcgatttcagccagcgtcatcaaactgcccagcacgtaatcgaccacgccgcgggcgttgcaaccgggtgcgctcgaccagacgatgcccgcctcgttgaagtaatccagatccaggtgatcggtgccaatggtgcaggtgccgacaaaacgcaccttgctgccctcaagcagcgcacgattgacgttggttaccgaacgcaccagcaacacatccgcctgttcgaccgaggcacggtcaatcgagcggccaggcacgcggcgaatctcgccgaaaccggcaaaaaaagcgtcgagcagcgggatattttcgtcggcaacaatcagcatggcgggctccttgggcggataaccagtttaacggcaggagctgccgcaggctgcgatcttttgctgctgatctaaaaaaacaacgtcaaaagatcgcagcctgcggcagctcctagaggttacaaatgcgcaacagaggatttttcctgaccaaggcgtcagcggcgtagaatgcggcgccttgcgcatcaacctctgtggacgctttgcctgtgaattccgtaactgaccaacctgtcgccacctccctcacccgcccagcgcggattcgcctggagttcaagaacctgctcgcgttggcgctgccgatcatcatcgcgcaactggcgaccacggccatgggcttcgtcgatgcagtgatggcaggccgtgtcgggccaaaagatctggcggcggtggcgttgggcaactcgatctgggtgccggtgtttctgctgatgaccggaacattgctggcaaccacgccgaaagtcgcccagcgttttggcgctggcagccacagcgaaatcggcccgctagtgcgtcaggcgctgtggctggcgctggtggtcgggctgatcgcgacggcgatgctggtggccgccgagccggtgttgcacttgatgaaggtcgacccggagctgatcggcccgtgcatgcaatacctgcacggcatcgccagcggtctgccggccgtggcgttctatcatgtcctgcgctgcaccagtgacggcattggccttacccgcccggccatggtgttgggtctgtgcggcctggcactgaacattccgctgaactacatcttcatttatggccacttcggcgtcccagcgatgggcggtgttggttgcggctgggccacggcgattgtgatgtgggtgatggcattggggctggccgggtatgagcgctgggcgccggcctaccgttccagcgaaattttcagccgtttcgactggccacaatgggcagtgatcaaacgactgctggcaattggtctgccgatcggtatcgcggtgtttgccgagtcgagcattttcgcggtgattgcgctgttgatcggcagcctcggtgccaccgtggtcgccgggcaccagattgcgctgaacgtcagctcactggtgttcatgattccgtattcgctgggcatggccgttaccgtgcgcgtcggtcaggcgctgggccgcgaagaaccacgcgaggcacgctttgccgctggcgtcggtatgggcaccgcgctggcctacgcctgcctgtcggcgagcatgatgctgttgctgcgcgaaccgattgcggcgatctacaccgctgacccgacggtgattcacatcgcggcgatgctgatcgtgtattcggcgctgttccagttttccgacgcgatccaggtcaccgctgccggcgcgctgcgcggttatcaggacacgcgggtgacgatgatcctgaccctgttcgcctattggggcattggtttgccagtgggctacgccctcggtctgaccgattggctcggtgaaccacgcggcccgagcggtttgtggcagggtctgatcgttggcctgagctgtgcggcgttgatgctgtcgatccgtctgacgcgcagcgcgcgcaagcgtatccggatcagtcgttcggcgggttaaattccttacacaagacaaaaaaatgtgggagcgagcctgctcgcgaatgcggtgtatcagtcgccatcaatagtgactgagataccgctttcgcgagcaggctcgctcccacatttggttttgcgttcgccttgggggctcaggcgtgtttcttgcgaatccagtacaggtaagtaccagcctcttcgtgctggctcaccaactcatggtcgagaaacacgcaaaacttggggatgtcgcgcttggtcgacgggtcggtggcgatcaccttgagcaggccgccgggtaccagatcacggatgtgttggtgcagcatcatcaccggttccgggcaattaaggccggtggcgtcgagggtgccgtcgaccggggtatcgatcatttcactcatgattcactcctgaaactggccggcattgtcgcgcactgccgggtgttcggtcatctatagctttaatccacaccctgtgcaggagctgccgaaggctgcgatctttgctttttaagatcaagagatcgcagccttcggcagctcctacacagggtattgcggtgttttagcgggattttgtttttttgatgtcgtgacggcgcaagtggcaggtcacttcctcgcggtcgtgatacagctgcttgcagccgatatcgaccttgatcccgcgtgccttgaaaccatcggcaatgcgttcgagcaagcgcttcacttcggcgtaacgctgcttcatcggcaacttcagattgaccaccgcctcgcggcaatggccctcgccgatccactcttcgagcatcgccgcgttgcgcgccggtttctcgacgatgtcgcagaccatccagtccaccggttgcttgggcttgaaggtgaaaccgtcggccatcaaatgctgcaccagaccggtgtccatcaggctttcagccatcgggccgttgtcgatggcggtcaccagcatgccgcggttgaccagttgccaggtccagccgcccggtgcggcgccaaggtcgacgccggtcatgtcgctgtgcaggcgatcttcccactgatcacgcgggatgaagtggtgccacgcttcttccagcttcagcgtcgaacggctcggcgcttcacgggggaacttcaggcgcggaatgcccatcggccacatcgctgagttgccggcatcggccatacccagaaacacttcgcgaccgctcttgaaggtcagcagcagacgcggcttgttcgcgtcctccaccagtttgccggcggcggtcagtgccttgcgcagcgggccttcgaatttcttgcagaagttcgacagttccttgccgtcattggtgtcgacgacctccagccataggctgccgcacaccgggaactcggctatgtgcgcgaggatcacgctgatgcgatcggtttccggcagatcgatgaagacgccgcgcgcccattggcgcgggaagatcagttcggcaaaacgctgaccgcgcatcaggcgctcggcgccgtcttcttcggtgcagacaaactcggcgcaggcggtggccgctttggccttggcgtagccagccacgttgagttgggcggcgaggtcggaaatctccgaacagacttcgccttcgaagcctggccggcaatgcatgaatagggtgttcattcttactcctgggcagcgggcgatcattcggcccctgcgcgatgtccagaccttgcgttgcagcaaagcctgtcacgaaaaccggcgcatgatagccgatgtcggaaccttggacttgcccatagagtccagttattagccagctaatgaaaacagggctacgttgatagctctgcccgtcccctcaatccgtagccgtgcggattcaaaggagtgatcgtaatgccgtccctcgatagtctgaagacccttaaaacactgcaaatcgacgacaagacctaccattacttcagtttgccggacgccgccaaaagcctgggcgatctcgacaagctgccaatgtcgctgaaagtcctgctggaaaacctgctgcgctgggaagatgaaaaaaccgtcaccggcgctgacctcaaggcgattgccgcgtggctcaaggagcgccgctccgaccgcgagattcaataccgcccggcccgggtattgatgcaagactttaccggggtgcccgccgtggtcgaccttgccgccatgcgcgcggcgatggccaaggccggcggcgacccgcaacggatcaacccgctgtcaccggtggatctggtgatcgaccactcggtgatggtcgacaaattcgccacgccgagcgctttcgagcagaacgtcgacattgaaatgcagcgcaacggcgaacgttatgcgttcctgcgttggggccagagcgctttcgacaacttcagcgtggtgccgccgggaactggcatctgccatcaggtcaaccttgaatacctcggccgcacggtgtggaccaaggatgaagacggccgtacttacgcattccccgacacgctggtcggcaccgattcccacaccaccatgatcaacggcctcggcgtgctcggctggggcgttggcgggatcgaggcggaagcggcgatgctcgggcaaccggtgtcgatgctgattcccgaggtgatcggtttcaaactcaccggcaaactcaaggaaggcatcaccgccaccgacctggtactgaccgtcacgcagatgctgcgcaagaaaggtgtggtgggcaaatttgtcgagttctacggtgacggcctcgccgacctgccactggccgaccgcgcaaccatcgccaacatggccccggagtacggcgcgacgtgcggtttcttcccggtcgacgacgtgacactggaatacctgcgtctgtccgggcgcccgccagaagtggtgaaactggtcgaggcgtacaccaaggctcaaggcctgtggcgtctgcccgctcaggaaccggtattcaccgacagcctggcgctggacatgggcagcgtcgaagcgagtctggccgggccgaaacgtccgcaggatcgcgtctcgctgccgaacgtaccgcaagccttcagcgatttcatcgatctgcaattcaaacccaccagcaaggaagaaggccgcctggaaagcgagggcggtggcggcgtggcagtgggcaacgccgatctggtcggtgaaaccgattacgaatacgaaggccacacctatcgcctgaaaaacggcgcggtggtcattgctgcgatcacttcatgcaccaacacctccaacccgagcgtgatgatggctgctggcctgctggcgaaaaaagccgttgagaaaggcctgacgcgtaagccgtgggtgaagagttcgctggcaccggggtcgaaagtggttaccgattactacatggctgcgggattgacgcaatacctcgaccagctcggtttttcactggtcggctatggctgcaccacttgcatcggcaactcgggaccgctgcccgaaccaatcgagaaggccatccagaaagccgatctcaccgtcgcgtcggtactctccggcaaccgtaacttcgagggccgcgtccacccgttggtgaaaaccaactggctggcctcgccaccgctggtagtcgcgtatgccttggctggcagcgtgcgcagcgatatcagcagcgaaccgctgggcgaggacaaacagggcaatccggtgtatctgcgcgatatctggccctcgagcaaagagatcgccgatgcggtcagtcaggtcaacacggcaatgttccacaaggaatacgccgaagtgtttgccggcgatgaacagtggcaggccatcgaggtgccgcaagcggcgacatacgtgtggcaggacgattcgacctacattcagcatccgccattctttgacgatatttccggcccgctgccggcaatcaaggacgtcaaaggtgcgcgggtattggccctgctgggtgactcggtgacgaccgaccacatctcccctgccggtaacatcaaggccgacagcccggccgggcgttatctgcgtgaaaaaggtgtcgagccgcgggacttcaactcctacggctcacgccgtggcaaccatgaagtgatgatgcgcggcaccttcgccaacatccgtatccgcaatgaaatgctcggcggcgaggaaggtggcaatacgatctacattcctaccggtgagaaactggcgatctacgatgcggcgatgaagtatcaggcctcgggcacgccactggtggtgattgccggccaagaatacggcaccggttccagtcgtgactgggcggccaagggcaccaatctactcggggtgaaagcggtgatcgccgaaagcttcgagcgaatccaccgctccaacctggtgggcatgggcgtgctgccattgcagttcaagctcgatcagaaccgcaagagtctcaacctgacgggcaaggagacctttgagatccagggcctgaccggcgtcgagctgacaccgcggatgaatctgccgctggtgatcacccgtgaggacgggggtcaggagaaaatcgatgtgctgtgccggatcgatacgttgaatgaggtggagtacttcaagtcaggcgggattttgcattacgtcctgcgccagttgatcgcctcgtaacgcatgccccatgtaggagctgccgcaggctgcgatcttttgatccagatcttggtttaaaaaaacaagatcaaaagatcgcagcctgcggcagttcctgcagggggattgtgcttttctgggggcgaaaaaaaacccgccgaagcgggtttttcccaagaccattatcgactccctgtcggcagcgatccttgcatatggtcgatcatccgtgatcctgaaacactccctgtgtctcagttgatgtgtgtaggttacgcagtggatccaatcggcaatagtcgtaaaagctaccagcgcgtgtaagacattcgccatagcagcccttccgaaaacccctagacgtgtcaggcatcgagcatggacgccgcgatctgcgcgactttcagctgccccgaggcctgctccaatgcgtcatcctccagaaaccacgctgccgacaacccggcgaacgccagcacccattgcagcagccttcgacgatcaagcccggcagcctcgacaattacctccagttgccggcgaaagcgctggggatcggtggccgtcggcagatccgggttgcaaatcaggttggcgtagtcaaagccgcgttcgcccctgacccgctttggatcaatcgccaaccagccacgcgattcgaaatccagaacattgtcgtgatgcatgtcgccgtgcagcaccaccacgtcctgtggagcggcgaacaaggcttcggcggtttgcaggctcaggtcgtagaggccgccatgttggacagcagcgattcgcaacgaagcgaaccatggccccagttcgaccagcggcggcggtcgcatcggacggggtgcatgcaatcgcgccagcgccgaacacagaatccggctcgcctcgtcgtcctcgccatgcattgccatgtgcatcagcgagcgccgccccatggcacgctccatcagcaggccatcttcatgatgcgccaagacttgcgcagcaccgtcaccgtcccaccaggtcatcaaccggttgccatgcttttcgtcattatccattgccactttaagcatggctggcgtggcgccaaggcgtaccggcagcagtcggctgccaggagtgatgatcggcgcgccgtccgtcactaaagaccaccgcgtcagccagggttcgaaaatatcagccaccgtcgcgctcgcgagccttggcactttcggcgagaaattgttcgagccggctcaactgctcctcccagccacgactgtccatgaaatacgcctctttctggcgcacatcggggatatgcgcaaaacccgactcggaaaccttgagcagtgtgccgtcctcgtaatcctgcaactcgaacttgaccagcgtggtcggctcttgggaatagtcgatcttcggattcaccgcatacggatgccagcgaaacgaaaacaactgctgcggctcgacccgctcgatcagcacattccacaacacatgttcataacccggatacgtgacctgcccttgtgtccattcaccggcaatgaaccgcctgccctccagcgccacaccaaaccactggccaaacgcctcggcatcgaccaatgcacgccagacatgagaacgcgtcgctttgagcgtgattttgcgttcgaaactattgggtactggtttcatacgtcacctcctgttctgaacactaggcttgtatgaccacatgtccaatgtgaagttgtatcaaggagctatttggtcacgggtgccacacggagttgcgtctagactcaagggtcaattcatcggatacaggaaaaccccacatgcggctgacgcacctctttctgtggacagccctgctgacgctgtctgcttgcgtgacatctgtcgatcactggagcaaacccggtgcgacccaggcgaccatcgatcacgataaagccgagtgccaatatcaggccaaatcggcaaccgccagttacagcagcgcaccgtcggacaaaagcatgtcagcggcagtcggtgccggggtgggtgatggcattgtggtggctgagaaacagatcgacctgaccaatgactgcatgcgcctgcgcggttacagcggtagttgaacctgatcgctacaatgcatggcaatcctgataccaagagtgagatcacaaaatgtccccacgccggttgctggccctgacgccattactattcccctccctcgcccacgccgccgtcgactgcgccaacgccagcgatcaggcgacgatgaaccagtgcgccgggcaggatttcaaagcggcggataaagagttgaatgcggtttatcagcagattaccgggcggttgaaggacaaccctgatggcaaaaaactgttggtcagtgcacagcgggcgtgggtcgggtttcgtgatgcggagtgcaagttttctgcatcaggagtgacgggcgggagtgtttatccgttgatttacagcaattgcctgactggggtaacaaaagtgcgggttgaggcgctgaaggagtatttgaagtgtgaggaaggtgacatgagttgcccggtgccgggggcctgagttttgcggcgatttttaagggcctcttcgcgagcaagcccgctcccacattggaatgcatttcaacatctgggagcgggcttgctcgcgaaggcgtcagaacagccgccacaaattaccggaataaaattatcgtccgccttgacgttgtcatgtccacgcaaaaaattcgctcgaaagagctagccagcctgctgggcatcaccgcggccaacttgtcattactgaagaatggcaaggtcagggcgtgaagatggccactctggacaaactctgtgcagcactcgattgccagccaggtgatctgctggaattccagaaagactgatccttgcgcaccagcgcaattaattgtcgccagtctccatcgtttaactcttattcaatccttagtacaaggctgctttttcatgacccgctttttattctgcgcgctgttttcactgacagcggtgatcagcggctgcgccacacaaatggacgtagcgctgaatgcgacacctgatccggattatcattttgaccgaaaggcgaccgtgctcgtgacgtctgccggcggcagcgacgaaaacgcgcttaacgcccgctactatctgcgcgacatggtgaatgcactgaaagacatgggctaccggcaggtttacaccgatgtcagtctgccgaagaaccacgcgccgataaaaatgaccatcagcctcgacattggtagccgacaagtgacctaccgctataccgctaccgattacgggcaggtgccgaccagcacctctaccgtgtgcaagaacagcaagaaaaaagacgatcgactcaattgcacgagtacaccaaacacaacctatgggccgataggtacctcggagcgcaccggttacaccacgctcagtacctttattgccaccgcacgcgatgaagtcagtaagcgaccggtctacctgctccgcgcttcgtcctataacgaagactgccaggcaaccaaggtcgaagactttctggtggagcaaggcttgcagaacctgaacttccaggaccgtgtgcagcgcaactacaccgtcacgatgcccgaaggctaccgctgcaagtagactttgcagggcaactaacagcctcggctctccagcatgagccggggctgcgaaccgttagacgtgcgggtctccaggcgccttggacggcgccgcatattgcggcttgagatggccgtcctgatcaagtagccaggcgtccatgatctgccgcaccacagggccggcgacacgaccaccggcctcgccgttttcgatcatcaccgaaatggcgatcttcggatgctcggccggcgcgaagccaacgaacaaggcgttatcgcggtggcgctcgagggttttctcgcggttataacgctcgccctgcttgatggccaccacttgcgccgtaccactcttaccggcgatgcggtattgcgcaccggccgctgctgcacgggcaataccacgagcgtcgtgcatcaccatctgcataccatgattgacctgctcccaatcacgaggatccttgagcaggatgttcggcattggattttcatcgaccggtgctatgccatcgaccgtcttggccaggtgcggacggttccacacgcctttgttggctatcagcgcagtagcttgggccagttgcaatggcgtgacctgcatgtagccctgaccgataccgaggatcacggtttcgcccgggaaccatgcttgtcgacgcgtcgcacgcttccaggcttgcgatggcatcaggccaggcgattcttcgaacatgtccagcgacactttttcaccgaggccgaacatcgccatgtagtcgtgcaggcgatcgatgccgagcttgtgcgcgagatcatagaagtaagtgtcgttcgatcgcatgatcgccgcgtccatatctacccagccgtcaccactgtggttccagttgcggtacttgtgatcgaagtccggcagttggtagtagcccgggtcgaagacgcgggtctgcggtgttaccacaccggcatcgagaccagcaatcgcaacttccggcttgatcgtcgagcccggcgcgtagagtccgcgcagcacgcggttgaacagcggccgatcaatcgagtcgcgcagcgccgagtactctttggagctgatgccggtgacgaacagattcggatcaaaactcgggttgctgaccatcgccaacacttcgcctgtagacggatcgagcgcgactaccgagccgcgacgatcaccgagtgctgcctccgccgcttcctgcagtttgacgtcgaggctcaggacgatgttcttgccgggtaccggatcggtgtgtttgagcacgcgcaatacgcgaccttgggcgttggtctcgacctcctcataaccgacgtgaccgtgcagttgcgcctcatagaaacgttcgataccggttttaccgatggattgcgtgccgcggtattcaaccgagtcgaggcttttggattctttttcgttaatccggccaacgtagccgatcgagtgagcgaaatgtgctccaagcggatagtggcgcacgaattggggttcgacatcgaaacccggcaagcggaactcgttgaccgcgaggacggcaatctgctcttccgtcagctcgtaaaacagcgttaccggcgtgaacggatggcgagactgcttcatcgccttatcgaagactgtacggtcttctgcaggtaaatgcaggagattgataacctcgtccagttcatggttgacgtcagtcgctcgttcacgggtgaaggtcaagttgtaactgggacggttatcagccaacaacacgccattgcggtcgtagatcagaccacgtgttggcggaatcggcaggacgtgaacacggttgttttcagagatggtcgagtggtagtcgaattccaccacttgcaggatatacaggcgcacgaccagggcacagctgacggcgaagacgaacaaggcgcaggcgatcaatcgtttgttgaccagacgcgtttctttttcgtgatccttgatcggaattggttcaggcatttctacagcaactctttgacataaatgagtgccgatccgtgggcatgacatcagtccgttaaaaaacgagctgcaccataccaaaaacagcccggtcacttcagaaggaatttccccaatggccatttcttgcgacggctgggacagcggtgtcccacgaaaactttcctacgggcaaaacaaaaccccaactgctttcgcaattggggtttcggaatttaatcttgacgacgaacatgtgtccaccatgtctccggtacatacagggagagggctagggtgaggggcttttgctcttcagttgacggtaccgcccttagagtcggccatgatctgccgaatcgccccgacaaacgtctccactggctgcccgcccgtcaccgcgtactgaccgttgaacaccactgtcggcaccgaactcaccccgcgctgcagccacagctgctcttcctcgcgcacctcatcggcaaactcgtccgacgccagaactgcctcggcccgctggcgatccagcccgacactttcagcgatctgcaccagttgccgatgttccgacggattgccgccatcactgaaataggctttgaacaacgcctctttcagcggcaattgcagaccttcaagccccgcccaatgcagcaagcggtgtgcatcgaaggtgttgtagatgcggctgttgccatcggtgcggaaggcaaacccaagctcggcaccccgggcgcggatcgcttcgcggttcttctgcgactgctcaggtgtcgagccgtatttctcttgaatatgttcggcaatgttctgcccgtcgacgcccattttcggattcagctcgaacggctggaaacggatctcggcctgcacttcgttgcgcaggatttccagtgcctgtaacaggccatacaaaccaacgacgcaccacgggcaagagacgtcgctgacaaaatcgattttcaaggcagaactcatcactcacctcgcgggggaaaatcgtgcgggaaagtttgcacgatacacctgccccggattttgtggcgtacccttcgcgagcaagctcgctcccacagggggacgcattccaaatgtgggagcgagcctgctcgcgaaggggcaactaccaacaccaaaaatccctcggttacagcaaattcccgcccaccaccggctcaatctgcgcccagtgcgatgtgtcttcccgatgcgcctgcaagtacggcagcaccgccgccagcaacggctccttgaacgcctcctgaaaacgatgcgccagccccggaatcagcttcaactgactgccgcgaatgtgcgccgccagatgcacgccatgcatcaccggcagcaatggatccgccgtgccatgcaccaccagcgtcggcagccgtaactgattgagcagcgctacccggctcggttcggcgaggatcgccatgatctgccgcttcacgccctcaggattgaacgcgcggtcgtaggacgccgccgcctgttgcagcaatgcttgccgatcgtcactgaccgccgggctacccagtgctgccaacaaatcagcctgctgctccagcgctgcctgccgattcggtgcgccgcgtcgcgacagcaattgcaccagcgccgcgctcggtgccggcaacccttcggcgccggaagtggtcatgatcagcgtcagactctcgactcgctgcggcgccatcgcggccatgtgctgggcgatcatcccgcccatgctggcacccagcacatgaaactgctcgacgtgcagcgcatccatcaaacccaacgcatcgtcggccatgtcggtcaggctgtagggcgccgccaccggcaaaccgagtttgtagcgcagcacttcaaacgtcaggttggcctcggccggtgcctggcgccaagtcgacagaccgacatcgcggttgtcgtagcggatcacccgaaagccttgctgacacagagaaaccacgacttcatccggccagtggatcaactgcccgcccagccccatcaccaacagcaacgccgggtccgatgcacggccgatgctctggtaggccaggctcacttgcgccaggtcgacccgttcggtcggtacattgacatcgcaacgcgaagccgccatcgacggcaggccgaacatcagcgcggccaacaggaaaaataaacgcatgaaaaacaccgaaacgcagaaccccagtagagcgcgagtctgatgaagtttgttcaagcgcgctgccacagttgcgtgacagtttgatgaagtttgccgaatggtcatgcacgcatgctcacgacagccccgcgtgacctcgacacctcctgaaacgatcgcggcaaaaagcgataactatgtaccgcagatgccagtgacggctcgcctctaatggcatgaagaccgggattagccggccttcatgttttctggagcctgtcgcatgtccgataccccttctacggccgacttcggcctggaccagcctctacggtcgaacctcgatcaaaacctttacctgagcgctggcgcacgtctgcgcgactgtcaccgccagtggctggacctcatggcccggtttccgaccggcagcgaccgcgactggagcctgcgtgcaaccggcacaccactgtcgcgccggaatcaggccctgcgcatctaccgtcagcacttcgaggcggccagccagatcgcctgtgcagaagggatgatcagcatcggacagttgcagacattgtcggcggccgtagatccttcaacagcggtcacacccgaggtgcatatcgcgcagcttcagctcaaacgtgccgatgacagccacgtctcgttgccgggtgcattgctattgcgcattggcaacgattcgcccggctgtcatctgttgtatctgccttcatactcgccagccttgagtctcttcaggcaacacgccgatctgcaccgctggctgatcggacattgccagaaacacagccggccgccgcagctgaaagcagcgacagtggtggaagtcgcgctcgatcacgacccactcgggagtaaccttgaagcacttttcaacctgccagccgatgcgcgcctttcacccgcatcgcccgacttgtcgagcctgatcgccgaaccacccttgccaactcccgatgaagcagagcctgtcgacgacccgaccctgttcggtctgctgaaccccgacattcctttcagccagcgcagccaagctttggctcttgagcagaaagccctcgaacaattgctgggcgatgccgtggcagccagcctgaacaccccgttacggcagaaactgacgcaacagttcgacgccttgagcgaggcgcaaaacgccagccataacgcggcttcagcgttgctcgaccaccgcgcgccactgaaaatgcttgagctgcgccacgccaccaatgcccattaccacgtcctgcatcaggcccggttacgcgggttgcgtgcagaagtcgaactgcaactgacgctcaatcagctctccgtcgatgaacaccggcggatcattgccttgctcgaggcacccgagcgtccgctgctccatcaggaaacagtatttgcccgtgtgactttggcggcagcggcagatgaccaaccgatgggagaggatctgaacggtgtgctggtcatcgctgcgccttttgcgctggagcccggtgccactgaaagcctgctgctgtattggcccgggcagtccggcggattgcagcgcttcagctcacgtcaggcgctggaacaaaaggtgttcaagcactcggccaatgatcgggagttgctgttgcaactgacgccaatcagcggcgatccgctcgtgtgggtacttgaacggcagctgttccaatgcgagcagcaggcagcaaccgtcatccgtgaaaatccactgccctcccgtgccagcgaacgtgcggcagcaatggagcaactgcgcgaacaacatctcacacgcttgaccgtgcccctgtcacaggcacgcgaactggcgtatgcctatcgcctcgaacaggaacgcaccgccacactcgccggcaacctgccgtcctggctggacaacctcgacaacgcacagcgcgcgcgtatcaaaacgttgatccgtgactacctcaacgccatgcagcgttgtcatgccttgctcgagcgtgatctgccagcgcgccccgccttcagcaaaaagcgccttgacgctcgactgcgcaaggatttcgcgctcaaacgaagcgtgtccgtgatgctggatctgcccgatagcaccgaatggcggaaaaccttgatcgacggcgcagcccctggcacaccgcaacgcaacacgctgatggcgagtacccggcgcagcgaactggccctcgaggaactggcgcaggacaacatggaccaggcgatgtggtggcgactgtcattcctgcgggtcaaggtcagcgccgaagatgagcaggatcgaaaagcggtggaaagcggattgactccggcctatttgcgcagctcattaaccgatctggacctggccggaggttatgaaacacttattcgccagacctttcttgggatgcccgacgaatcagcgttcgacctggcgtatcggcgcgaatgcctgagcgagccatggcggttgatgctcatgctgcaaggcgaattcgccgtactgcaacggcatatcgacagcgccggatacgcgctgctgaagattgccatcgatgcctcgacgcgggaagcatatagcgtcaagggccaacgtatcgtgctgttgcctgcacatctgaccgtcggcggcgcggacaccgcccaccaggggccgagcaccctggccggggtgacgttcatcgtcgaacaggtcagtggcctgaccctgctgtatttaccggacagcaccgacgggattttgctgcgccagtacgccacgctggaagaggcacgtctggatctgttcaaacgttgcgtagacgcgcgcatggtcaactatctggccgggcgcaccttgagcggcgattttgccagccatgtcagccggatcaatgaggcgcaactgcgcaatttccacgcgctgatcggcaccgggctggcctggccaacctcgacgtcactggccacgcacttgctcaatgtgcacatgggccgaatgctggaagctcatcgcagcagttctcgctccaatgacgccttgtatctggaaacatgcgcactgaagtccggcacgctgttcaactacctgaaaatggccgtgggcatgctgccattcattggtgcctcggtcgccctgtatgacgcgtggaacagcgccaacctcgcggttgcggcgtttctacgcggagacatcgggcatggtctggcggaagtcgaatcggtgttgctgtccctgatcgatgccgccatggatattctcccagcgacgatctcggtacccgccgccgcccgcctgataccacgccagcgccgcggtacagcattgacaacaaagtccggtgccacaccgacctcatggcaatgggcgcgccagtcacttgatcgcttcaagggctacgagtatgaattcgagatttccctgacgggtctgcgaaccgatagccacggcatttatcgcaatgtctatcgccatcccgatggggatttcatggtgcgtcaggggcgcatctaccgtattcagttgcacgatgccccacgcggctggaggctctatggcacgtgggcgcgcacctataaacagccgatcgcccttgatgaggccggtcaatggaacacccattacgccgtgcatggcacgttgatggacggcggcggtgccggcggtggcgcggccatcgggcatttggccaatggcctcgacccgctctggcccgaatccatccgtcagtggctgccacgttggtggaccgatcgccaactgcgcaggcaactgactctgaccaacaccgtcgatgcctacacccggcgccttgatacccagacgcgcagctccaaccaacttctggaacgttaccggcaactgcccattgccgagcgtcaatctctggaagcgacggttgacgcagcctgtctcaacgatatcgaactggcccaggtgctataccagaatgttgccgaactactgccgctgagtcacggtagaaaacgcctgttgctcgaagacattcagagtcgctgcgcatgggcgcaggttgatcggtcattacagcgcgccgccatttcccgccaacgcctgctggaacatctgaacagtgtcgacgcactcgttgcgcagtctgacgcgacacccgtcgataacactacagcccatataagtctcatggcccaacgcaaagtcgtgcgcaaaaacttcctcaaggagttcgatcaccagcacggatttatcgaacaggccaatctctggcaaagccgcatcactaaccgggcgcataaagccagaatggcagtggagctcgcgccactcaaccaacggtttggcgaaaccacgcactattacctgagaaccgcgcacattctggagatcattacccactacgaggcggtcgacgacctgtcctgggtctactttcacgtgcaactcaaagacgcccgggtcaaggtcggacgtgctctgctgacgcagcatcatttacctgaagtacatgccagccttgcccaacgcaaccgtgtgatcgaggactgcctggaaatctacgcaggctttcgacgtcagttgaacgcgtggtcactgggttatccgcagcacctggatctcgagcaggtcaaggcgtttctcgacggtctgacccaggttgaacagcatgcccgtcaagcgatcaagcaacgtccgccgatcaagcccaaagaagcgggcggcaagcaattgtttgaaaccgaggacaaccaattgctgatcggtatcgaaagtattgatgccgggacccggcaaaagcgtttcaccatcgcaggactcgacggttaccgggaaacctggctgccgcgttcgagcggcaagtaccatctggacgcgcaacctgcggcctctgctcaatccttgccaaccaacgtacaacccctgctgagcgaagcccgcaagcgtctcgccgccgtacccgcctataacagcaaagtcaccggttacgcgcgccaggacatgctgccaatcgatctggaacacatgttcggcagtgaatcgacagaattgagtacccgtgcgaatgccatcgcgcggctctcgccagacgagccgctggtcgtgcaattgcaggacaaggctcaggagttgttaagcctcggccgtacgttgcgcatcgaccagtcactgcgcagcagaacacctaccgagggatatctggactatctgctgcaacagaaaaaggtcgatatccgcaaggagggcacactgcgcgcactgggcaaacgacccgacgggcgcaaagactttctccaggagtacgaggtgcgcgatctgagcaccaatccgccacgcgcgctttggtatgcgcactttcactacacctcggacaaggtccctttcgaagacttcgtcaaagctcatttgaaactgcccgagcagcgcaaccttggtctgcaatggcagcaggcgcaggccgcgagtggcgcgcaggtcgaagcgatctggcgtggcgatgtcggtagagcgctgggcattcggcacttttcaaagctctaggtaaaagcagcggagcattaccagtgctccgctgccataaaccccggacatgcagaaagtcatgctggtcgacagctacaccaacatgagacaaactcaccgcaatcactatgatcacaaatttgtttcatggagcctgcagtgcttgaaatccgtcatctgaaaaccctgcacgccctgcgcgaagccgacagcctggtcgacgccgctgaccgcttgcacctgacccaatcggcgctgtctcaccagttcaaggaactggaggaacgtctgggcatgccattgttcgtccgcaagaccaaaccggtgcgtttcaccagcgccggtttgcgcttgctgcaactggctgacgcgacactgccgctgctgcgcgccgccgaacgtgacatcagccgtctggcaggtggcactgccgggcgcctgcacatggccatcgaatgccacagctgctttcagtggctgatgccgaccatcgaccagttccgcgacgcgtggccggaagtcgaactcgatctggcctcgggtttttccttcgccccgctaccggcactggcccgtggcgatctggatctggtggtaacctccgatccactggaaatcgccggcatcacctacgtgccgctgttcacctacgaagccatgctcgcggtagccaatcaacacgcattggcgagcaaaccgtacatcgtccccgaagacttgctcagcgaaaccctgatcacctacccggtggagcgcgatcgcctggacatcttcacccgtttccttgaaccggccgacatcgagcctgcacaggtacgcacttccgagctgacggtgatgatgatgcagctggttgccagcggccgtggcgtctgcggcatgccgcactgggcgctgcatgagtacagctcgcgtggttacgtaaaggccaagcgcctgggcgagaaaggcctgtttgccacgctgtacgcggcgattcgtgcggacatgctcgatgcgccatacatgcgcgatttcctgctgacagccaaggacacttcgttttcgaccctggacggtgtcagcgcggttcgctgaagcctttactgctggagtcagagttggcgccacatgtggatcttatcgaagtaatcttcaccgacccgcaccgccagcggttccaggccgaactggatgaagccgcagcgctgatagagtttgcaggcggcgccgttgccggcggttacggtcagttggacaactttcaatgccgggtggttttgcgcttcggccagtgccgcctggaccagttcgaatcccaggccatgctcgcggaagtcggccgagacgtacatgccgaacaaagtggctttatgtcgggctttctcgcgcggctcgaaggcgagaccgacaatgccggccagccggcccccctcgaaagcgcccagcacaacgtcaagcttgctggtcaggcgcccttcccaccagctcaacggcatcactgcgcgctcacgcacactggaagtgaaagcctgcggatgccggtcataagcctcaagcatcagctcgcgataagccagggcgtgactggcgtccagccgttctatccacatgttcaagccgtcctgcgttgctcaagcatcagccgcacagcgaggccgccgaggacaaaacccatgaagtaacgctgcatcgccagccacgtcggattacgcacgaaccacgacgcaatgcctgccgcgaacaacgcaatcagcaggttgacgctgaaactgacactgatctgggtcaggccgaggatgatgctttgagtgaacactgaaccgtgctcaggcgtgatgaactgcggaaacaccgagaggtagaacacggcgattttcgggttcagcgcgctggtgaggaaacccatggtgatcagtttgcgcgacgagtccggcggcaactgctgtgcctcgaacggggaacgcgcgccgggtttcaccgcttgccaggccagccacagcaggtacagcgcaccggcccacttcaacacttcataagccatcggcaccgcgaggaacactgcagtcaacccggccgccgcggcaaacagatgcacaaagaaacccgccaccacacccaacaacgacgtgatcccggccctgcgtccctgacagatcgaacgcgagatcaggtagatcatgttcggccccggtgtcagcaccatcaacaaggctgcagcggcgaagatcagcacgtcttgaagcgggatcatggcaaagtcctttgcgaggatgatcaggcgatggccgtcaatgattggcgataaaacggcaggatcaggtcgcgtgtcaatggcgccagctcgacggctggatcagtggcaggatcgacccagatcacctcttcgatttctgctgccggtgtgacctcagcatcgatggtcagttggaagatctctgcttgtacaacgaaacccggctcgttggcggcgggggcggaaaactggccgagaaacgtcgcttgcgccgaatcgatctgcaaacccaattcctcttccagttcacgtgccagcgcatgcaccggcaactcgtgcgcttcgatcttgccacccggctgcatgaatgccgtagtgccgcgcttgcgcaccaacagtgtctggccgtcagtgttaagcaacagcgcggcggcaatgcggatcagggcaggcgtttgtgcggaaaaagtcgacatgacagagaaagccttggcgtaaaaacggcaagcatcacatgcctgccgtttgtgcgcaaagcggttgccgacgatctcaggtcgcttcctggaaatccatttccggaggctggcgacggaagccgccggtgagtatcgccagatacaccacgccaatggccagccagctcagccccagatagagcgccagatgatcgaggctgaccatcagccacaagtccgcgaccagaccgatgaacgggaagatcagaaacagcaccagctcacgcgggcctttgttctcgccagcgatccagtaatggaagatcaccgacaggttgaccaggctgaacgcgaggaacgcgccgaaattgatgaatgaggtagacgtggtcacgtcgagtttcagcgccagtaacgccaccaccgcacagagcaggatgctgttgaccggcgtaccgaagcgcgcgtgcagggtgccgaaaaacgacttcggtaacaccccgtcacggcccatggcgaacaacagtcgtgaaccgctggcctgggcggaaagaccggaggcgaattggccgacgatcagaccgatgaggaaaatcgacacgaacagatcgccgccaatattgcgggcaatctcgtaagctgccgagtcgacactgtcgaactgcaacgacggatgcgcgatctgcacaaagtacgacacgctcacaaagatcaatccgccgatcaaggtgatcaacatgatcgcccggggaatggtgcgtcgcggatcgcgggtttcttccgtcagcgtgctgaccgcgtcaaaacccaggaacgaataacaggcaatcgccgcgccgctcatgatcagtggcatctgcatgtcgccgttgaagaacggcttgctcgaccacagcggcgtgctcgcatcgccgccgatgtagtgcacgcagagcgcgacgaacgcgatcagtacgaggaactgcaccagcatcaacaaggcgttgatgccgttggccagtttcaggccgacgatgttgatcgtactggtgatgccgatgaacgccagcacccagatccactgcggaatcgaggggaacgccgacgccagataggctgcgccgatcagccagatcgccatcggcaggaacaggtagtcgagcagcaccgcccaaccagcgatgaagccgagtttcgggctgatcgccttgcgcacgtagctgtaagcggaaccggcgaccgggaatgcggcagccatgcgcccgtagctcatggcggtgaagaacatcgccaccagcgcggccaggtaggcggccggcaccatgccagcggtggattgcgcaagaataccgaaggtgccgaggacaatgatcggcgtcatataggcgatgccgaacagcaccaccgaccctaatgacagggtgcgttgcaaacgagccatgagcgacttactccgaattttattggatttatggcagagccgggttcggcgaatgttttcgggtgtgttttattgttctggtgttggctgatcgttcccacgctctgcgtgggaacgcctcaatggacgctctgcgtccgctcttgggacgcggagcgtcccgggctgcattcccacgcagagcgtgggaacgatcgggtaaaacctgagtgcgactcggtatttcaggtcggcgtacctcggacaatcaactcggtcagtcccctctccccctgggagagggttaaggttagggtgagggcatcggtcaacggcgtggaatcaacaactcacgaacaccatcgccacgctcctccacctcccccggcaacttcaaacgctgatcatcgagatagcgataatccctgcgtgcaatctctaaccggtcgaaatccagctcaacactgaactgcccttcttcccgtccggcctcgaacagcaacgtccccagcggatcgaccagcgcactgccacctgcaaacaccaaaccgtcatcccccgcctccacgcggttgaccatcaacgcaaaggcctgattctcttgcgcgcgggccatgatcgcggtgcggtgcgtcggcgcgtacgggtccatgttgccgttggtcacgacaagcaactcgacgcccagttgcgccagggcacgcgcggtttccgggaactcgatgtcgtagcagatcaacaggccgacacgcaccccgttccactcgcaggtggcgtagcggtcgccggcctcgaacacaccgcgatccgacgcccacagatgcgtcttgcggtatttcagggcgatgccttcaggcgtgatcaacaacgtggtgttgaagaagcgcccgttgtcgttctcggccatgccgattaccacggcaatattgcgttcgcgcgctgcggccaacaccgcgctgacggtcgggccatccagcggttcagcggtttgcgcgacagtctcggcagtcgggaagcccatcaagtgggtttccgggaacacgatcagttgcgtatcggcagcacacgcggcaatcgccgccaaggcgcgttcgaggttgtatgccgtggcattgtcacggcccgccagttgggcgagttcgactttcatgagaattccttgttatgagcgtcgggcgctgaaagattgcccggtggctgtctgtgggccagtatgcgcagcaagcagccggccagggaatcacgcggccggggtaacccgataggggtagttgcatgacactttcgtttgacgacatcacctggcaccgcgccgtcggacaactgatcgacgcgctcgacaaaccgaatttctgggcgcaactggtgcgcctgctggatcagtacgtgccgttcgatagctgggtcgcgctgctgttcagtgccgatcagcacccgcaggtctttgccgaatgccccggtgaggacggcagtcctgatcagttgtttcaggattatttgcgcggtctgtatctgctcgacccgttttacattgcctgccgcgagcaatcgcgcaccggtttgtatcgcctgtcggaggtcgccccggagcatttcgagctgaccgagtattaccagcgatactttcgtctgaatgtcgtggccgacgaaatccagttcaattgccagctcgaaggcgagcgcacgttgtgcctgtcgctgggcagcgaacagcgttttacctctgagcagatcgccctgctgtcactgattcagccgtgggtgctcggcctgctacgccagcggctaccctatgaaatcaacgaaaccgtggcgctcgccgccgcacctgcgcaggcagactggcgcgtgcaactggaagcgtcggtgcagcaactcaagggcgcgcaactgaccgcccgcgagctggatgtaggccgcctgatgctcagcggttgctccagtaaagaaatcgcccgtaagctggaaatctccgtagaaaccgtgaaagttcataagaaacacatgtacagcaagctgggaatcaaatcccagtccgagctgttttcgatttttcttcaggcgcaaaacgcctgatcgtttggtgaagtttctctatgtaggagtgagcctgctcgcgatagcgtcgggtcagtcaaatcatttttagctgatataccgctatcgcgagcaggctcactcctacaggggaatgtgtttatccctcaatcttcgctgattattccgagtccgaaccaaggaaaccgtatgagcctgtcactcctgagccgctacgccttctttgccgtctgcgtgattttcaccctcgccagcctgccttttctcgaacatgactggctgtggccgatcaccgtcgtcaccggcgtgctgagcctgctcggcgtgttcgacctgttgcaaagcccccacgcagtgcgacgcaactacccgatcctcggcaacatccgctatctggttgaaggcatccgccccgagatccgccaatacttgctcgaatccgacagcgacgccttgcccttctcccgagcccagcgctcgctggtctattcgcgcgcgaaaaacgaaagcgccgacaagcccttcggcacactgatcgatgtctaccaggcgggctttgaattcatcggccactcgatgcgcccggcgccgctgagcgatccgagcagtttccgcgtcaccgtcggcggtccgcaatgcacgcagccgtactcggcatcggtgttcaacatctcggcgatgagcttcggctcgctgagtgccaacgcgatccgtgcactcaaccaaggcgcgaaactcggcaacttcgcccacgataccggcgaaggcagcatcagcccgtatcaccgcgaacatggcggcgacctgacctgggaactgggcagcggctacttcggttgccgcaccagcgatggccgtttcgacccggaacgcttcgccacccaggcacagaatccacaagtgcgaatgatcgaaatcaagatgagccagggtgccaaacccggccacggcggcatcctgcccaagcataaagtcaccagggaaatcgccgagacacgcggcatcatgatgggcgaagactgtgtgtcgccgtcacgccacagcgcgttttccacgccgatcgagatgatgcatttcatccagcaactgcgtgaactgtctggcggcaaaccggtgggtttcaagttctgcctcggccatccgtgggaattcatgggcatcgccaaggccatgctggaaaccggcatccttccggatttcattgtcgtcgatggcaaggaaggcggcaccggcgccgcaccggtggagttcaccgaccacatcggcgtaccgatgcgcgaaggcctgctgttcgtgcacaacaccctggtcggcctgaatctgcgcgacaagatcaagctcggcgccagcggcaagatcgtcagtgccttcgacatcgccagcgtgctcgccatcggcgcagactgggccaactccgcacgcggcttcatgttcgcgatcggctgcatccagtcacaaagctgccacaccaacaaatgcccgaccggcgtcgccactcaggacgctttgcgccagcgtgcgctggtggttccggacaaggcgcagcgtgtgttcaatttccatcgcagcacattgaaagccttggcggaaatgctggccgccgcaggtcttgaacatccatcgcaactgtcggccaaacatctggtgcggcgcatgtcggcgactgaaatcaaactgttctcgcagctgcacgtgttcctcaaaccgggggagttgctcactggagaggtgaacggcgaattttattcgcggatgtggcagatggcgcgggcggacagtttcgagccaaacgaaatcgccgcagcataagctgaaaagcgtcagtctgtacgacaggctggcgcttcatacctcacggttgcgaaacagtacaaagcgaaaaaacagtacggctcgcccacaaaaaagccccgaccttgcgaccggggctttgatttcagcgtctacaacttacgaagccgagcgcgccgcaacttgcgaatcaccggtcggttgcaacttgaacacatagaacaacaccgtcagcaggaccaggaacgccgggccgatatacagcgccacgcgggtgtccgggaagtacgccatcaggccgaccaccagcaccagaaatgccagtgcgaagtacgagctcaccgggtacagccacatcttgtatttgaggccggcacgctcgctggcgctcaggcctttgcggaatttcagctgagccagcaggatcatcacccaggtccagatcgcaccgaaggtggcaatcgaagtcacccagacgaagactttttccggcaccagatagttgagcattacgcccaggagcaataccgcgatcgacaacagcagcgcacgacgcggcacaccgttgttggaggttttggcgaaaccggccggcgcctgaccgttctgcgccaggctatagagcatgcgcccggtgctgaaaatgccgccgttgcacgacgacagcgcggcggtgatcaccacgaagttgatgatgccggcggcggtcttgatgcccagacgttcgaaggtcatcacaaacgggctgccctgggtgccgatttcattccacggatagatcgaaaggatcacgaacaacgcaccgacgtagaacagcagaatccgccagaacaccgagccgatcgcatcgggaatggtcttctgcgggttcttggcttcaccggcggtcaggccgatcatctcgacgccgaggtaggcgaacatgaccatttgcaaggacatcagcacaccggtcacgccgttgggcatgaagccgccatgggcccacaggttggagatgcccagcgccacgccgtcattgccgaagccgaaagcaataatgccgaccccgccaatgaccatggcgatgatcgtgacgatcttgatcagggcaaaccagaattcgaactcaccgaaggccttcaccgcgatcaggttgatcgaacccatgctgaccagcgccgcgagggcccagatccagcgcggtacatcggggaaccagatgcccatgtacaccgccaccgcagtgatttccgcgacgcaggtcaccagccacaggaaccagtagttccagccagtgaggaagccggccaacgggccgagatagtcttgcgcgtaacggctgaacgaaccggccaccgggttgtgcacagccatctcgccgagggcgcgcatgattaccaggatcgccaggccaccaaggatgtaggaaatcatgatcgccgggccggccatttcgatggccttggccgagcctagaaacagaccgacaccgatacaggcgccgagcgccatcaagcgaatatgccgttcgccgagttcgcgtttgagcggaccgccctgagcggtttcgccgtgaggcaggtgattgccgactggcatgggggtgcaacctcgtcttgttattggatatgaccaccgagtgtcgaagcctcgaccgataagccttggctgctgtgaaaccgcgcttgcctcgtgggcagacgcgtcttgtaggacaaaacctgcaagatcagcggggcgtgcagtataaaaagccttgggcaggatttttcactctataaaccacaacattcagcgacaactctcggcaaaagcccggtttacggagaggcattccctgggtttcgcaggaattttcaccgctgaaaaaggcggcgagtattgcacagcattggtgcaccgtcatgcccctgcctaagtgcaattgatcctgcaaaggctctaactcagaactctctgactcacattgcccctgtggtgaggggatttatccccgatgggctgcgaagcggtcccaaaaccagtcactgcagattgtctgacacaccgcggtgactggttttgcgtctgctacgcagccgaacggggataaatcccctcgccacaaatctccaaacctcaaagccatctgctcgacttccagatttgttcagcacttcccctcccccaacccttcacaattttttcaccagcgccaaccaccgtctaagcttcagacaagtccgatcaatctgtgtggatggatcaatcgactatgggcgctttgtggcaaaccgattcgagtaaaaccgtggttccgactgaacgtgtggatcaagcgcctgtccccgataaaccacgccgccctcggcatggctggaaggcattctggttgttgctgttgattatcgcgatcgtggcaggactggctgcgtccaaagaaatgcgcacctcgcgcttccagtccgctgaagtcagcaagtacgcttcttcgctgacctacaagctggaaccaggtcccagtgaagcgatccgttaccccggcaatggtccgttcgatttacgtctgggctacagctctctcgatgaattcctgccgcgcctgctcaagcgcagttacgtgatcagcgagcaaacgcgtttttctccggccttgctcagctacaccgacaaaggtctgttcgtgccgtattcggaaaaaatccaggctggcctgaccatcactgattgccgcgctgcgccgctgtacaaatacaactatccgcagcaactgtatcccagcttcgcggcgataccacccgtggtcgtcagcagtctgttgttcattgaaaaccgcttcctgctcgaccccaaacagccccgcgccaatccggcagtggattggccccgcttcggcatggccgcgtggtcgcaggtggcgaaattactgcacctgcccggtcagtcggctggcggcagtacgctggcgacgcaactggaaaaataccgccactcaccggagggtctgacggtgtccggtgcggagaaaatccgccagatgatttccgccagcgtgcgcgcctatcagcctggcccgcaaaccctcggcgcacggcagaacatcgtccgcgattacctcaatagcgtgccattgtcggcggtgccggggcacggtgaagtacacggcatggcggaaggcttgcgggtctggtacggcagtgatttcaccaaggccaacgagcaactgaacagcccggctaccgatccgcaatccatggccgacaaaggcctggccttgcgcgaaatgctctcgctgatgatcgcccagcggcgaccttcacattacctgaccaagggccgtgaagaacttgccgacctcaccgacagccacttgcgcctgctcaagcagaacggcgtgatcgatgccgcagtggccgatgcagcactggccagcaaagtcacctaccgcgactggcagacccaaccgaccatccagcctatcgaaaccaataaaggcatcagcgtcgcccgcagccgtctggcgagcatgctcaaccgaccgctgtacgacctggaccgcctcgatctgtcggccaccagtaccttgcaaggcgacttgcagacccaggccaccgagtacctgaaaaaacttgccgacccggccttcgccgcgcagatcggcttgatgggcgagcgcctgctcaccccgaccagcacgacccaggtgcgttacagtttcaccctgttcgagctgaccccggacggctcgcgggtgcgcatccagactgacagtaccgaccagccgttcgacatcaacgaaggcagcaagctggaactcggctcaacggcgaagatgcgggtgctgaccacttatctgcaaatcatctccgaactgcacgacaaatatggcggcatgtcggtaccggagctgaagaaagtcgaaatccccgatcaggatcgcctgagccagtgggtcatcgattacctggtgcaaaacaaggatcgcgacctgtcgaaaatgctcggcgcggcgctggatcgcaaatattccgccagccctggcgaggcgtttttcaccggtggcggtttgcacgtgtttcacaactttcgcaaggaggacaacggtcgcataccgacgctgcgcgatgcgcttcgtgaatcgatcaatttgccgttcattcgcctgatgcgcgatgtggtgcgctacgtcacctactccggccccaacagcagcgccgaattgctcaaggatgatcgtgacccgcgccgtcaggaatacctggccagtttcgccgaccgcgaaggcacctcgttcctgctcaaattctggaagaaatacaaaaacaaggacacccaggcacggcttgatacattcctcgacagcatgcgtccaacgccgatccgcatggccgccgtgcaccgttatctgttgcccgatgccagccaggaagacttcaataccttcgtgcgcgcgcacctcaaaggcgccaggctcaatgaaaaacttaccgacgatcgccttatccgtctctacgattcctatggccccggcagctacgacctgccggatcaaggcttcatcgccaaggttcaccctctcgacctgtggttgatgggctacttgctgcacaaccccgacgcgacgttcagccaaatcgtcaaggccagccagttcgagcgtcaggaagtctacagctggctgttcaagagcaagcacaaaggcgcccgcgacagtcgtatccgcaccatgctcgagatcgaagcgttcctggaaattcaccagcgctggcaaaaggtcggctatccgtttgaccatctcgtaccatcgctggcgactgcgatcggtagctctggcgatcgccctgcggcattggccgaactgatcggcaccatcctcaacgacggcgtacgcatgccgacgctgcgtatcgacagcctgcactttgccgcagacaccccgtacgaaacacgcttgaccaacgacccccacgtcggcaaacgagtgatgccatcggaagtcgccacggccatgcgcgaggcgctctcgcaagtggtggattcaggcacggcgaaacgtgtttctggcagtttcaaaatcgccgacggcacgccactggtcatgggtggcaagaccgggacgggtgacaaccgcatcgaagccataggttccggcggacgcattctcagctcgaaatccatcaaccgcactgcgacctttgtgttctacatcggcaacaatcatttcggcacgttgaccgccttcgtgcctgggcgctcggcggaaaacttcaaattcacctcggcactgccggtgcaggtgctcaagggtatggcgccgatcctgtcaccgtacttgcaaccgggcacgcacacgatgtgccagacgccggaggtcaccgcagcgcgttgatgcacagaacgcttgcgccgaggcgataacattgtatttttcacaccttgattttcgacgccagacatcgaattcagtgcagttccaaacagttttttgcgctttttcaggtgagtgttgttgcctagtctgattgtcccattctgatcaaggacgatcacctcaatgcccctcattcccttgcctggacgaccgcccgcaccctcaacgctggcgcctgccgatgccagcgttcattacgagacaatcgaaaaagccctgccagcctggctgctgagcagtaatgcggcgcgcatcaagcagttgaaaaatacccgcgcgccccttgcacagtggcatcgagaggcttcgacccgggatcaccagcgcctgaaaaacgacctgcaactggcctggaaaagccagaacggcgtcgatagcgcactgagcaacctgcaagacgtctacgcctttgccaaacccttgttgcaggaggcgcttaagcagcgctttgctgtcgaggatgacgtcgagcacacctggctgcgcttgtatgcgccagtgaatacatcatggtggacgcatgacttcgctgccggaacgaaaagccgcaccgtctctctgctggatgctgcgctgcataatttttcccgtaacgaagtcttcagcaaggactcggagttcattactcgccctgacgccaatgggcatttcagcgttaagccacttaaacacaaactgacggtcgaacaattcaagtcactgtgtcgggaactggatctcggtgctcgctacgaaaagcatttgcatgcatttctactgccgtccgatggcgttgcaaagcaggtcttacgacacaaagtcgtgctcagccaaaagtccgcgatgaatgttgccgcccgtatggcgctgattaaaaaagacctcagcgaggatgcctaccacgttgtcaaaggcatgctggatgaccgccgcaacctgcaatggaacggtcaaccggtcgattattacaaccttgccctgatggacgtgacgttgaccgggattgtcctcatcatccctgatgcaggcagcgcgaaagctcctgtcccgataattgcctacgttccccacgaccctgaacatccgttcaagcaatacgcctcggcgctcgaattcatgagcgagctcacccggcaattgcgcaacaagtcctcgccggcaagctatcagacgttcttcagccagttcgtcaatcagcaacagcgtgggcatttcttttcacgtttgaacgaccgcctgagccgggttaaatggcaacccgcatcgccaggttccaacgcaccgagctggcgcgatacaccggtggacaaccccaatctgcaattcagcctgttgcggttccgggatgatcgcgagactcgtttcaacggtgatctatggggttatctgtatcgccaaaagctcaacaaaatccttggtgacgctgcagagattgcgatttccaccgcctacgccgatcaaatggcgcgctgggcctggtgggacaatctggagaaactgctctcggacattttcaacgtagcactgctggtggtaacaccgttcgtcccctttgtgggcgagctgatgctggcttacaccacctatcaattgcttgatggcgcattcgaaggagtggtggatatggccgaaggacactttgccgaggcgggtgagcaagcgatcggcatactcgaaagcgttgttcagttgggagcgttcgccgccggagccaccctcggtcatgtcgcccggttcaagttgtcgccgttcatcgagggcatgaagccggtgcaactggcggacggccagacgcgcttgtggaatcctgacctgacgccctatcgcttgcccgatcaggccctgccgacaaccgtaacgcccgatgcacaagggttgcattcggtgggcgacaaacagctgctgcggctcgataagcatctgtttgaagtaaagcaggatcggcttaccggccagcatcgcattcgccacccgcagcggccccgcgcctactcgcctgctctcgtgcacaacgcccgtggcgcctgggtctgcgaaacggaaaacccgcgacagtggtccgctacgcaactgatgcgccgggtcgtccatggcactgaaggttcaagcgatacgcaactggaacagattcgtctgtttaccggcaccgaagagaacacgctgcgtcgcatgcatgttgaaaacactccacctccgcccttgttgctcgacaccctgatacacctgggtatggcgccagatgaggtcgcaccagctccgtcgctacccgcccgacaagtgttggtggattgtccgcaactcacgtccgtccttgcagaacgtgtcattacccaggcgcggccgatggagttgcagcagattgccctgcgccgtcgtttgccgctgcgcttgagaacattggcgcgcgaggtgcaattcgaactgcaatcggtcagggccgcccagggcttgcagctcgaaacgctgagcaacgtcgacagcgagcgtctgattctcgggaccttgcgccactacagcgacacttttggagccctgcggatcgagatccgtgatggcgctttcgatggcgagttacgctgcagcgccggtagcgattcagccgaacaggttcgagtgctggtgcggctcgcgacagaccgctaccaagtgcgcgatggcgaaaatcgtcccatccacgacacgagtggtctgtatgaatcgatccttcacgccatcgacaaggacggcggcagtgtcctgggttaccggccgagcgagattgaacccttcaaacagtggattctcgccaagaccacggcgctgagtgagcgccgcacgctgctcgccagcccaccgatacgcccggtggctgaatacgacacattgtttctggtgcgtggcgcaggcttgaccaaaaatgccgtcaccctgcaggagcgcatcgaggatctgcacccgcatttcagcccgcatgaagtcaacgtatttgctgaagccctgaccgagcaaggcgaaccgctcaaagccattgaaactcaggcaacggatctcgatgagctgcgcaatatcgttcatcgctggcgttaccagcaaccggagacctgggggccgcatagtcagagctttcgcgacgatggcgggctgcatatttatgagcgtctgctcgactgtttcgaacgcaagaatgaggacctcggcaaccgcgcagatcccacgtcttacaccctcgacctctcgcgggaaatgctgccactggacctgcagacctggtgggcaaagcggccggttttgaagaaattcctcgacaaagtcaccgtgctgaaactcgacaacacacggtttgccactgacccgtccagcctgctcaaagacttcccgcacctgatcgagctcagtgccaaaggttgtggcctgccacgtttgccagaccagataggttcttcggtgcgtcggctcgagcgccttcgcttgagcgataaccagatcgtcctggatcccgccgccgtcgcgcgcctgcgcagcctgacttatctggaagtgttgaaacttgacaacaatccattgaatttgtcgcccgacctcacacgcatgcctcgcctcaaggtgatcacactgagaaataccgggctgaccgcctggcccgaaggaacgctggccaagccccgcccgcgtggttttctcctcgacttgcgcggcaatccgctgtcccgattgcctgaagtcgcgacggggtccgatgcgcaatggctggtggcacgcacgcgactcgacgtcgccgggttgtcggaaatcaaccagttgcgctatcaggcacaccgtcgctcgatggccctgcctcccgagcctctcataccgcttggtcatgcggaaaacacctcgatcgtctcgacctacggcgccgattactggggcgacgttccaggctggggcgtgaaccgcgagacaccttgggccgaactggtcgaagagcccgccgcccagccgttcatggcgaccttgctcagtgttcgggactttgccgattaccgcgccggaggggccgttcgcgatcaactgatgcaacgcgtctggcgcatgctcgacgccgtgcacgttgacactcgtctgcgggaaaaactcttcaccatggtggtcgcaccggttgactgcgccgatgccggagcgcagctgttcaaccatatgggcatcaacgtcctggctttcgaagcacgtgcctactccatcggtccggcagagcttgagctgaaactggtgacactggcaaaaggtgcggcgcgactggagcatgtcaacgagattgcccgggccgacgtcgcgagccgtggcggcaaccccgatgacgttgaaatctacctggcgtatcagacgggactggccaaacgcctcggtctgccctggcagtccgaaggcatgctttaccgacaggtgtccggcgtctcggacgcgatgattgatcaggcgtatgacaccgtactgacgctgggtgaaggtgacggcctggtaaacgcgatgctcgaactcgatttctggacgcaatacctgagcgacaaatacccggtgcgcagcgaaagcaataaacgtctgtatcaagccagatatgagcggcttgaaagcctacgcgaaacccagcgccaatgggttgaatcaacctcggacgacgatcgcgcaacgcttcgggagcaactcaacgcattgatcaacgaattatcggtgccgccgaccgtggtgtttgacgaagcccccttcagcgacgcggtattcgaccgtttactgatcgatctgggcgatgacgaaaaggagctcgcgcgacgtttgacccgtgaagcattgaagcgcgccggactttgattccgacgtaaaagtcctgggtctgttcattgaaaccggacagacctgcgaactcagggcgccgccgcattgaatatcaggtgcacgttgccgtaataatttcccggtttgtagccaccggcgggcacgatcggctgaatatccagcacgtaacgccctccggccctggcctgctcggcggaaagcacctgacgcggcgtcgcatgagtcagcacggtaccggcaaagctgacacgcaaatagatgttttgctcgtcacggccattggacaggtagggttcactgtccagccgggcctcgattgcactggtgtcgtgcctgacatcaaagtgcttgcgcacgccgcccagggttttcgtactgacattccacggcagaatctgcgcgcgatgaatccagtccgtctcggccggtatgacgtaaaaacccagcgtcggaatgtccaccgacacctggaaccggtgctcctcgcgcgccgcaaatagcccggcactgaacaacgtcagaacgcccgcgcacaaggcaatgaacgattgcttgatcatctcaggtcatcccttgatgagttgccggcgacgcgcaaagtctttttgctgtcgccctcgaccagattgaagcgatattcgcgtccgggcttcttgtcgaattcgaaactgttaccagcgcggatgtggtgtttggtggtcggctcgcaggcgttttcgtccttcagggcacaattgcgaaactcatcgaccaccaccacagtgttgccgttgttgcgcactcgatacgtcgttggcgcatcttcgatcacgctgtcgaatcggctgtttttcgggcgcacaaagaacaccgtaccgaaaccggtcatgacgttgaccccggcagacaagttgtttttgtattcgtcacgctcttcggcggagactgcgaattcatcttccttttccggcaccaccgggatgaagcgcacacggaaatagcgctcggtgtcacgcgcgcccatcagcagaaggcgtgtgccctgcatgccattggccggcacgatcagccgtgcggggctggccatcaggccatcacgactggccatgtccgcctggtttctgacctcgatttcccgcgacgtaccgtcggcctcatagacgatttcgaggatgttgaccttgacgaatgcggtgctgtcaccgctgttgaacacccgtttcaggtaggtgcttttatcgccgtcgaggtagtcgtacaccgcccccacgttgatctgcggcccggccgacacggccagggaaaaactgctcaaacccatcatcagcaacaatcgtttcatagccataaacctctttacattgaacacaacgcaagcttcacctgtcggacttccgagcccctgtcacggtgatgaagactgagcagcagcaggaaagaacgtaacaaccaccgctgaatccctgtgcaagtcttcacgccaaaacgccctgtaaaactgactcgcacggcgaacatcggccacggacggtggccagcctgttcgtagctcgcgccctcagatatccgaatcccagatcaccacgacaacacctgagtaactgccgcctcggccttcaccgggccgcagcatgtttgccatggaatgcgcaggtacttcgaaatgcagggttcccggtgcccgatccacatagaagccgggtttgaaatacagctcattccccgcacccggcctcagtcgcaagcgcctcaccggttggccggaaaggtcggtgatgccattgggcaggctgacaaaaacgaacagttcgacccgtcggttaacctcggaatcttccagtgcgcattcgccattaaatccgggcccgcaacctataaacatcttgaaacgtgacgacgcccagatgttgaaagtctgatcgcggaacaggctgaccggccgccgcccggcgtgcagccagctctgccagccgccgacgggcaccagctggattttctcgccaccgggggggatttcgactttcagggtgtgctgaacctcaagattgaaatcgagggtcaattcagggtcattcggaatcatgacgtcgccgaagtcgaagtctgccccagggccaaggcgataactcaagctcccggtgtaattccccgacgacatgtccaatggatttggcgtacgcagttcgtaggcaaaatccagataggtgtagctcatggcagggattggaaagttggcgactttcacgcaggggctttcgtttggggttaaccagaaaaaagcgtaggttttctccgaaaaaaaaccgaccccggtggtttgacagggaggtgccggattcacccagctcgagcctttccataacgcagtgtgcccatcctctgcgttcgaggcgccggttaatttggcagctgtatgacttaactcataattggagctgatgcccgcaatacgtacttcgacacgcttgacgtctccggtatccacattcgtgaccaacaacgaacgccaccctgccggcgccttgaacatggcactgttacgtgaatcagcattggcttgcatggctttgttcgactcgacgcgtgtcatcaggcggatactgaaaatattgctcctggcacatatatcggggtagtactcacagtaaccactgggcggcgtcttgttgacgaactcattacgttgcggattggaggagtcaggcgtgaacaacgccttgatttcctgggtcaccgctcccgccgaaggtgacgtcaacatcgccagcaaccccagcagtgagccacggtaccgccatcgcggcgaaaaaatattcagggtcatgattgcactctgtgaaggatcaatactggagtcatcagccggccttctgctgactgatgctggcctcggccaacgtgtccggcgagcagcgcagatctccgatcatcaacacgttgttttcactacgatgcctgtcgacatcaagacggaattgacacaacaactggtcggcgtagcgcacttgcagggtgggcgagccggcatgcatctccatcgagaaaaacccgtcgacttcgctgacgccacggctggcgtgattgatcacgtgatgccccttgagcggccgtccttgtgggtcgacgaggcgaccaagtacggtcagggttttcatcacgcgcaccttgcggtactccacgccgcccttgttcaggtgataacgggtacgcgacggttcgatactcgccgccgggacgtgattgccgtcaaagtcgaagctcaccgaactattgcggtaggcagtgagcggtatgaagttgcgtccggggtgcagagccgcgctgccgccactgagatcgtcggcgcgcagggatatgccggcaatgtccgactcgacatcgacgatcatgcccgcgccgcgcccatggtgctggctggtcatcaacagctgtcgggcgccaatcaccacggtgctgtcgaggtttaccccaccggtgaagttgccgttgtaagacgagcgctgcaggaagccgtcgccattgaccgtgtcggtgcgaaagttcgccaggctggccaggctggccaggccgacaccataagtgtcggtcagcgccgtcaccgacacactttgcagtacatggtcttgcaggtccttgcgataacccaccgaggcattgttgtcacggctgccatcgcgcgcggtgcggctgccgatgctgccggatatttgctggcctgccccgcccaacgccatgctgacactaaggtctacgccgcgattgcgtgcatcgccactgctgtaactgcccggtcgatcaaacaacgacagccgccaattggcgtcgctgccgaatagttcggtacgctgcgaccagcccagatcggcgccgacaccttcaacattgccctcgctgtgggacacccgcgcactcagcgagtttttgcggctgatccggtgactgagcgccagcgacgaattgctggtctcgccggtgaagacgttgcgttggcgtacacgcgtaccgtcgggcagcgtgtcgtaggtattgcgggtgtcgagccaactgcgattgtggctgatcaccagactcccggcgccgtagttgtataacccctgcaaatcaacgccggtgccgtgatcctcggtctgataaagattggcgtaaaaactggtgttgtccgcgacactccagtcgatcgagctgccgtattgcagttttgcgcgtacctggcgcgccgacagtccgagaatcacccgcggatgcagcagataattgatcgaggcgccggcggtcatgtcgccgctgtcctgctcttcccagttactgagcagtttgctttcctggccggcgaacaggttgtagcgccagcggtcgtcgaggttgctccagttgacgggtttgtagatcagctcctgagtggtcgaggtcgtctgaccgtcttcgatcaaacgcacttccacttcgtagataccgccaggcaggggccgggtatcaagtgtctgcaggcctgcgggaaccgcctgggtattgatcagcaggccatcgcgatagatttccactgacgcctgccggttggccgtgacatagatcggataaacacttggccggggactgtccaccgcaaggctgtcggaactgccgtacatcacgcccaccgccgtgtcgggactggtaccgaatgaacgcggttgacgggtcaggccttcggaattgggggtgaaataacccaagcggaaaaaactgccctgcagttcgcgctgggtataaagctcatgtattgcgtgataggtcttgtcgtccggcccgccgagacgcgccaattgcatgttgaaggtctgactccagttaccgaggctgccactggcctccaagcctagccggccacccggatcctggtcctgaccgccgttgaagttgagttggttgcgcaggatcagtccactgctgccgccctcgggctgatcgtgaaagcgctgggtctgcagatcgcgctcggcattttccgtggcaatcgagagcaaggagttttccaggttgtaatgcaccgccagcaattgctcggggcattgtccgctacacgtccccaaggcgactccgggtttgagaatgctcgcccaggtttcacgctcactggcgctgaaacgactgtcgctggtgtcggtaaagtcgagcaaggtaatacgatcatcgcgcgacaatacaatcattgcctcgcccaacggctgtctatcaagttccacccgaaccgccaatggaacatcaaaaaagtgctcttcaaagtctgccggcaaaccttttgcctgcgccagtaagcttcgcggggtgttatcaactggtgcgggcgccgccagtacgctggtgcatgacagcaacgcaagcgcagccgcgatgggcgtcatcggaaacatgaacgaatactctggttaccggaaagtaaaagcccgaccggacaacagacaagttgccggccggttacgttacttggacaagtaagcgttagttgctgcctgtagcgatcaaaccgaaggttctacgaccagcatgaccacgccggtgtaatcgccagcggttggcttggcgcctggcgcactgattttgaacggtgcgcggtagcgtgtattggactctgcatcaccgaccacttcctgggacgtggtggtcagcgtcttgccattgagttcgaccttgagatcgatactctggctgccggcgataagcttcggcacgctttccaagcgagcgtggaccttgccggccgtgtgcagcacgtcgaaatgaccattgacctcacgcatcgaagcagtcgacgggttgtagctcatgtcctgatccttgttgaccagatcggcatcgaccggtaccgcatagaaatcgtcggcaggcacatgcgcaaccagactgatcgaatgttttgcttcggtggcggcgaacgcgatggaagcactcatggccagtacggtcagaggagcggcaaaagcgagtttcttgagcatcattcaatacctgtcatatataaattggtttattcattgaaagtgtctggcgaacgaacgttcacgaacgaggtgtgtccaccctcaacttgcaacgccagacaatcatcaagcaattcatatttaaagtaagcaggcaacttccgaggaacttgtagcctggcggccatcaccccagaaagaaaaaaccgttaatttctgaaaaattcaagttcaactgtaagagagagactacagcgcgccagcagtctgtcttggcgcgccaacttttaaagcaacttccgtaagaccgataccacactctcctgataataaaggccgtcatcggctattagagagttagcactaaactgcacttttagcgggcgatttaataccgcttttttttgatcattcgcgcgcagggatgcctgaaaattcgattgatggaaggcagccgtcggtcagaaagccttgcgcaggcctaaagatatatcttaagttgtatctaaacacgacgagagataaggaaaaaatgagagaccatcatgccccccaccgcgaacacggcgacgctcgtgacggcttcgagaaacgccccggccgcgaacgcggcggtcgcggcccccgcgtgttcgctccaggcgacctgaaattattactgctggcgctgattgccgaacagccgtgccacggctatgacctgatccgccagattgaaggcatgttcgatggcgcctacagcccgagccccggtgtgatttatccgaccctgacctttctggaagaaagtgacctggttgccggtgacgccgaaggcggtaaaaaacgctacagcgtcaccgacgccgggcgtctgtctttaactgaacaagccgtggcactggacggtgtgcgcatgcgcatcgaagtcagtaaacgctcgctgcgaggccatgatcgcccaccagaaatccatgaagccgtgcataacctgcgccatgccttgcaaatgcaccacgggcgctggagcgccgacgaaatcctgcgcgtgcgtgacctgctcaacgacaccgccaaagccattgtcgacggccctgccgttcaatttgcccaggagaaagccgaatgaccgcagtcgatacccaaaccattcaccgcgtgatgcacgaaatcaaacgccgcaagcttgaagtcttgcgcgtggtcgacctgaccccgcgcatgcgccgtatcaccctcggcgggccggagctggccgggttcgtcagcctgggcacggacgatcacgtcaagctgctgttcccgcagaacgccgaacaaacggccgcgctggagaccatggtgctcggcgctggcaaggacaacgggccgatgccggaaatgcgcgactacaccccgcgtcgttacgacctcgatgcgctggaactggacatcgattttgttctgcacggtgacggccctgcgtcgacctgggccgagcaagccaaaccggggcaattcctgcacatcggtggcccgcgcggctcgatgatcgtgccggacatcttcgacagctatttgctgatcggcgatgaaactgccctgcccgccatcgcccgccgcctcgaaggcctggcggccaatcgcaaggcgctggtggtgatcgaagtggagaacggcgccgagcagcaagtgctggagagcgcggcgcaggtcaatgtgatctgggtgttgcgcgagggcggcaaggacaatttgctggcgacggtgaagcaattgcaggtgcccaagggcaatctgtatgcgtgggtggcgaccgaaacgaaagtctcgcggcagattcgccgggtgctgattgatgagcatgggctcgatgagcagctcatcaaagcggtcggttactggcgcgccgaaggcactcctgaagaagagtgatatcccttgtaggagctgccgcaggctgcgatcttttgatcttgtttttgaaaaagcaaagtcaaaagatcgcagcctgcggcagctcctacaggtgctttaacttcgtgcaaatctccagcggtcgagaccaatgaccaccaagccaatccccacaaaccccagcaatatccccccggcattgaccagcacctgtggataacccaacaccgccacatcaatgaacgggtacgcatacgcgccgagcaaatgcccgcgcaacaacgcgtagatgaaatacgccagcggataaatcagccacaccggcagatgccaccagcgcaaagtgcccttgggcacgcacgcccaccaatagcccagaaacagcagcggcatcacgtcgtgcagcagttcatcggcgacaaattgccaaccttcgggatgccacaaatgccgcagcagaatgctgtaggccagtccgaccacagcaatgctcacggcaatcccgctactcacccacggctgcaaaaaccagcggcgcgcagcggattcacgcgcggtcacggcacaggtcagcaccgtcgccaccagcgtattggtcaaaatcgtgaagtaactgaaaaagctcaccagcccgcccaacaggctggcgccaacactcaagcgcgcgaagaaaatcaggtacagctgaatgcccaaccccgcccagcccaatacggccgcgcaggtgatcaggcgatggcgccacacggcgtccatctcaaagcggtcgcttggtgcgcatcagcttcacgtacagacgctcgaccttctcccgcgcccacggggttttacgcaggaacgtcaggctcgacttgatgctcgggtcgctcttgaagcagcgaatatcgatgcgctcggccagccccgaccattcgtaatgggtcaccagtgcgttgaggatctgttcgagggtgacgccgtgcagcggatcgggggtttggtcgttcatgccaggcctttgggcgaagtgaaaatgcagaagccgcgcaccttagccgagggggtggttcggtggaagggcttccttcaaatgtaggtcaaggtcaaaagatcgcagccttcggcagctcctacaggtgtacgcatttcaatgtaggagctgccgaaggctgcgatcttttcgcactgttaccaaatccgaaaggatgcatgtttataaaaggcctttgtctttttgttacagatcattatcctgccgcccttccgctgaatcgcttcactgcctgcgacatattgaagcgcacgaattgcacccccgaaaacaccaaaaaaagacttatccatgcccgatttttccttctcccgagacagcgctatctcagccctgcgcacccttggcagctgcactgcgctaggtctcgccacctgcgcacaagcggcgcccgcgttcgacagtgaatcaccgtacatgctcggtgactggaacggcacgcgcaccgaactctcggaaaaaggctacgacttcaagctcgattacaccggcgaaatgggcagcaacctgcacggtggctatgaccatgaccgcaccgcgcgttacagcgatcagttcggtctgggcacgcacctggacctgcaaaagatcctcggctgggacgacgccgagtttcaactgaccatcaccaagcgcagcggcaacaacatcagcaacgaccgcatcaacgatccgcgtgtcggtggtttcacctcggcccaggaagtctggggccgtggccagaccacacgcctgacgcagatgtggtaccagcagaagttcttcgatcagaaactcgacatcaaggtcggccgtttcggcgaaggcgaagacttcaacagcttcccgtgcgacttccagaacctggcgttctgcggctcgcaggtcggcaactgggtcggcggcatctggtacaactggccggtcagccaatgggcgctgcgcgtcaaatatcacctgacccccgagttgtacgcacaggtcggcgcctacgagcagaacccgtcgaacctcgatcgcggcaacggcttcaagctcagcggcagcggcactcagggcgcgatcctgccgatcgaaatggtgtggacaccgaagctcaacggcctgccgggtgaatatcgcgccggttattactacagcaatgccaaggccaccgatgcttataaagatcagaatggccaaccggcagcgctgagcggcgaagcctaccgcagcgcgtcgagcaaacacggggtgtggctgggcattcagcagcaaatcaccagcgtcgccagcgacaacagtcgcggcttgagcgtgtttgccaatggcacgatgcacgacaagaaaaccaacgcgatcgacaactacgtgcaggccggcatcacctacaaaggcccgttcgacgcgcgcgccaaggatgacatcggcttcgccctcgcccgcgtgcacgtcaacccggcctaccgcaaaaacgccgaagccagtaaccgcgccaacgccgtgtatgactacgacgacccgtcgttcctgccaccgcaagacaccgaatacagcgccgagctgtattacggcgtgcacgtgaccaactggctgaccgtacgcccgaacctgcaatacatccgccaccccggtggcgtgaacgacgtcgacgacgccctgatcggcgggatcaagatccagtcctcgttctaaagcacaccacggatcaaatgtaggagtgagcctgctcgcgatggcggtgtttcaggcgacatctccagagactgacacaccgctatcgcgagcaggctcactcctacaaatgaatttcgttagctagacaagtttttatctgaaccatgcccacgcccaatcgtcatctacagtgactactgcgcgggactacttgaaacgtcacggagaatcacactatgagcaccgaaagtgcttcgagtcggggccgtttgctaccgagcctgctcggcattctgcttctactgatgggcctggccatgttggccggtggggtcaagctgagcatgctcggcggctcgctgtactacctgctggccggtatcggcattgcgctgagcggcatcctgttgctgatgcgccgtcgcgcggcactgggcctgtacgccatcgttctgttcgccagcaccgtttgggcgctgtgggaagtcggtctggactggtggcaactggtgccacgtctggccctgtggtttgtcctcggcttcgtgatgttgctgccgtggttccgtcgtccgctactgctcgacggcccggcgccaatgggcactcgcggcctgaccgtggccgtggttctggccggtctcaccgcgctgatcagcctgttcacccacccgggcgaaaccttcggcgaactgggccgcgacaccgccgacaccagcagcaccgcaccagcgatgcccgatggcgactggcaggcctacggccgcaccgaattcggtgaccgttactcgccgctgaagcagatcaccccggccaacgtcggtaagctgcaagaagcctggcgcatccagaccggcgacctgccaactgccgatgacccggtcgagctgaccaacgaaaacaccccgctcaaagccaacggcatggtctacgcctgcaccgcgcacagcaaagtgttggcactggatccggacaccggtaaagaactgtggcgcttcgacccgcagatcaagagcccggtcggcttcaaaggcttcgcccacatgacctgccgtggcgtgtcgtactacgacgaagccgcgtacgccaaaactgaaaacgcagcctccgcggtgatttccgaagccggcaaagccgttgctcaggcttgcccgcgtcgtctgtacctgccaaccgctgatgcccgcctgatcgccctgaacgccgacaccggcaaaatctgcgaaggcttcggcaccaacggtgtggttgacctgacccaaggcatcggcccgttcaccgctggtggctactactccacctcgccggccgcgattactcgtgatctggtgatcatgggcggtcacgtcaccgacaacgaatcgaccaacgagccatcgggcgtgatccgcgccttcgacgtgcgcgacggtcacctcgtgtggaactgggacagcgacaaaccagacgccaccgagcctttggcaccgggcgaaacctatagccgcaactcggcgaacatgtggtcgctggccagtgtcgacgaaaaactcggcatggtttacctgccactgggcaaccagactccagaccagtggggcgcagaccgcaccccgggcgccgagaaattcagcgccggcgtcgtagccctggacctggccaccggtaaagtgcgctggaactaccagttcacccaccacgacctgtgggacatggacgttggcagccagccaaccctgctcgacatgaaaaccgccgacggcgtgaaaccggcgctgatcgccccgaccaaacagggcagcctgtacgtcctcgaccgtcgtgacggcacgccgatcattccgatcaaggaaatcccggttccgcaaggcgccgtgaaaggcgaccacaccgcaccgacccaggcccgttcggacctcaacctgctggccccggaactgaccgaaaaagccatgtggggcgcgagcccgttcgaccagatgctgtgccgcatccagttcaaagaactgcgttatgaaggccagtacaccccgccgtcggaacagggcagcctgatctacccgggtaacgtgggcgtgttcaactggggcggcgtctcggtcgatccggttcgccaaatgctgttcaccagcccgaactacatggccttcgtttcgaaaatggtgccacgcgagcaagtcgccgccgacagcaaacgcgaaagcgaaaccgctggcgtgcaaccgaacactggcgcgccatacgccgtgatcatgcacccgttcatgtcgccactcggcgtaccgtgccaggccccgtcctggggctacgttgccggtatcgacctgaccaccggcaaagtcgtgtggaaacgcaaaaacggcaccagccgcgacagctcgccaatcccgatcggcttcaccctgggcgtgcctagcatgggcggctcgatggtcacggctggcggcgtcggcttcctcagcggcaccctcgaccaatacctgcgcgcgtacgacgtgaacagcggtaaagagctgtggaaatcgcgtctgccggcgggtggtcaagcgaccccgatgacctacaccggcaaggacggcaagcaatacgtgctgctggttgtcggcggtcacggctcgctgggcactaaaatgggcgactacatcattgcctacaaactgccggaataagttttagcggcggtaaaacaaaggcgatgtctcgtgagggacatcgccttttttgtgcaccacatatccatgtaggagctgccgaaggctgcgatctgttgactttggtttttaaaagccagatcaaaagatcgcagccttcggcagctcctacagggtggaatgggttggctgtgggaaatttgctcgtcctacaaatgctggtgattgcacggagtttttcccacaagtcgcgtcggttgtgcctcggaagtggggtggataggctctgagggtcgctgcaaattcagcgaacgggcgtcgcggcccgataactgatgcataatcgccaacctcacggcacctcggtgcctgtagcttgtgtcatggcggctgtgcgcgggataccgtccttggaggtatgccgatttctcagttatcggtccgcgaacccgcgtacagctgccacctcagattgcgtcgcggcaatcgaaggcagctccactttcaccaactgagtattcaccatgatcaaaccaacccccaatccgcccgcagcggacgacaccaccccctacgaattccccggctcaaaaagattccacgacgccgccgaacgcgccctcgaccactacctcaaacccaacgccctaaccctgcgcttccacaaacccagcaccatgttccaggtcgcccccgaccaagacaacgaaagcctgctggtccacgcctgcgaatccctggcccaagccagcctcatgaccagcgacatcgccgcctacatcgaactgccgcagcgacgcacgattctggcgatccagcaaatcatcatgctcgccgaactcgcggtgaaccgcgcactggataaccacgaactccccacccaaaactgacaccgacctgtaggagctgccgaaggctgcgatctgttgatctggatttttaaaatcaaaagatcgcagccttcggcagctcctacatgtgaatcgagttcacccgccagacacaggtcggctgtcaggccgccttcgcgagcaagctttgctcctacaagccagatcaaaggatcgcagccttcggcagctcctacatgtgaatctagttcatccgtcagaacaggtcggctgtcaggccgccatcgctggcaagccagctcacaggaattgagttcacccaataaattttcgcatcgcgcccgctcttcaccactcaacacgatgagcgcaagctcgggtgaagctcttgatcttgatccacgagcgacgtcggaaggctgagtggagggattgatccgggggtgggagcgcagcgaccgtttggcgcagccaaacacagcgagaggaggtgcagcgcagcaaaccgtaggcgctgcgcccggatcgatcccggagcgaaggaaccccgagccccagcgagcgggccgcacgtaggagcaagccttttgggttaccttttcggcgtttggaaaaggtgactcgccgtaagggcgaaaccgccagccgcaacacccaaaaaaacggatatacacccaaccccccaagaacatggtcggcccaaaggccgccaagcccaaaagcgtgacccctgtcaaaaccctgaacacacaagcagaaacatcccctcccattgaaaccacccaagccctgccccatctaagacccataccccattgcgcaggtgccccatgagcgaccagcaagaattcccggaaaaccccgacgactacaccgaagccgaacacatcgaacacacctcctccggcaaaggcctcgccctgccaggccagaacctgccggacaaggtctacatcatcccgatccacaaccgcccgttcttcccggcccaagtcctgccggtcatcgtcaatgaagaaccctgggccgaaaccctcgacctcgtcagcaaatccgaccaccactccctggccctgttcttcatggacacgccccaggaagacccgcgccacttcaacaccggcgccctgcccgaatacggcacgctggtcaaagtccaccacgccagccgcgagaacggcaaactgcaattcgtcgcccagggcctgagccgcgtacgcatcaaaacctggctcaaacaccaccgcccaccgtacctggtcgaagtcgaatacccgcaccagccgaccgagccgaccgatgaggtcaaggcctacggcatggcgctgatcaacgcgatcaaggaactgctgccgctcaacccactgtacagcgaagagctgaaaaactacctcaaccgcttcagccccaacgacccgtcgccgctgaccgacttcgccgccgcgctgacctccgccaccggccctgagctgcaagaagtgctcgactgtgtgccgatgctcaagcgcatggaaaaagtcctgccgatgctgcgcaaggaagtcgaagtcgcgcgcctgcaaaaagagatttcggcggaagttaaccgcaagatcggcgagcatcagcgcgagtttttcctcaaggaacaactcaaggtcatccagcaggaactcggcctgaccaaagacgaccgcagcgccgacctcgaacagttcgaacaacgcctcgaaggcaaagtcctgccggcgcaggtacaaaaacgccttgaagaggaaatgaacaaactgtcgatcctcgaaaccggctcgccggagtacgcggtcacccgcaactacctcgactgggcgacctcggtgccgtggggcgtgtatggcgaggacaaactcgacctcaagcacgcgcgcaaagtgctcgacaaacaccacgccggcctcgacgacatcaaggatcgcatcctcgaattcctcgccgtcggtgcttataaaggtgagatcagcggctccatcgtgctgctggtcggcccgccgggcgtgggtaaaaccagcgtcggcaaatccatcgccgaatccctcgggcgaccgttctaccgcttcagcctcggcggcatgcgcgacgaagccgagatcaagggccatcgccgcacctacatcggcgcgcaaccgggcaaactggtgcaggcgttgaaagacgtcgaagtgatgaacccggtgatcatgctcgacgagatcgacaagatgggccagagctaccagggcgacccggcctcggcgctgctggaaaccctcgacccggaacagaacgtcgaattcctcgaccactacctcgacctgcgcatggacttgtcgaaagtcctgttcgtctgcaccgccaacaccctcgattcgatcccaggcccattgctggaccggatggaagtgattcgcctgtcgggctacatcactgaagaaaaagtcgccatcgccaagcgtcacctgtggccgaaactgctggaaaaggccggcgtgtccaagggcagcctgagcatcagcgacagcgcgctcaaagccctgatcgacggttacgcccgtgaagccggcgtgcgtcagctggaaaaacagatgggcaaactggtgcgcaaagcggtgatgaagctgatcgacgagccgaaagcggtgatcaaactcgggccgaaagatttggaagcgtcactgggtcatccagtgttccgcaacgaacaagtgctgtccggcaccggtgtgattaccggtctggcgtggaccagcatgggtggcgcgacgttgccgatcgaagcgacgcgcattcatacgctcaaccgtggcttcaaactcaccgggcaactgggtgatgtgatgaaagaatcggcggagatcgcctacagctacgtcagctcgcacttgaaacagttcggcggcgatgcgaagttcttcgacgaagccttcgtccacttgcatgtgccggaaggcgcgacaccgaaggacggcccgagcgccggtgtgaccatggccagcgccctgctctccctcgcgcgcaaccagccaccgaaaaaaggtgtggcaatgaccggcgaactgacgctgaccgggcatgtgctgccgattggcggggtgcgtgagaaggtgattgcggcgcggcggcagaagatctttgagctgattttgccggagccgaaccggggcaattttgaggaattgccggattatctgaaggaagggattactgtgcatttcgccaagaaatttgccgatgtggcgaagatcctgttctgacagttctgcggtgacatgactactgctatcgcgagcaggctcactcctacagggttctatggtgaacagttgatttgtgaacgccacaacccactgtaggagtgagcctgctcgcgatggcgtcaacccggtcaccttcaaccccagactgtcacactttgtctcatcttcagttatgctcgcgttcgtcctgaacgcccggagccgctgaccctatgtcccccactcgcctgtttctccccctcgccctctcgctgctggccgcctgcgccacgcaaccgaaacacaacgtgaccgtggaaaaacaaagcgaatgccccgtacggctcaccaacgggcaaaacctcatcatcatgctgccaagcaatccaaccaccggttatcgctgggccattcaggactcggctggcggtgtgctgcgcgcgctcagccccgaggtctacagcaatccggaagatgccggcgtggtcggtgcagcgggtctgtcgacctggcgctttcaggcgtttgcccccggtaccgggcgtctgcgcctgacctcgcaacagccatgggcgccggaagtgctgccggtggaaacctttgactgcgccatttcggtgaactgattgtgggctggctgattctggcgctgatgggcgcggtgacctttctttacggcgtcagtacgcatgcggcgctgctttgtctgttggtcaaaccgttgccggtactggcgttgctcggctggttgcatgatgcgccgcccagcgactatcggcgctggatcagcctcggcctgattttttcgttgctgggtgatgtgttgttggcgtggccgggggatttgtttgtgtttgggctgggcgcgtttctggttgcgcacctggcttatctgaaggcttatctgagtgactgcaagcgtctggcggtgttgccgctggtcttggcactcgcggtgggtgcggtgttgctcggactgctgatttccagtggtctggggccgttgctggtgccagtgattgtctatgccacggcaatcagcgcgatgctctggcgcgcgcttgctcgtctcggcaccgatgtgccgaaacgttcggcgttgctggcggcgggcggtgcgctggcgtttgtgttctcggacagcgtgatcggcattgatcactttgtatcgccattccatgctgcgccgtacgtcatcatcctcagttattggctgggccagtggggcatcgccgcctccgctttctcccagactaaacggatctgatcgttcccacgctccgcgtgggaatacatcctgtgacgctctgcgtcatttgcgcagggacgcggagcgtccggggcggcattcccacgcagagcgtgggaacgatcaccggcaaaaaaacgctttatcagacaacccgcgcatccccgcgcccttttggctaaaatgccggcctttccatttacaccgccggaaccgccgtgagcaaagaacccgatcgcattttcgccaagcctctggcccaggtacccgacttcgccttcaacgaagacgtcgtgcgggtgttcccggacatgatcaagcgctcggtgccgggttatccgaccatcgtcgaaaacctcggcgtgctcgccgcgcagttcgctcagccgaacagcgtgctctacgatctcggctcatccttgggcgccgtaacccaggccctgcgtcgccacgtgcgcaccgacggttgccgcgttatcgctgtggataactcggccgccatggtcgaacgctgccgcgagtacctcaacggtcaggattcgatgttccaggagttgctgccggtcgaagtgatcgagggcgacatccttgccctcgacttccagcccgcctcggtggtcgcgctgaacttcaccctgcaattcatcgcccccgaccagcgcaccgcgttgctctcgcgcatccgccaatcgctgttgcccggtggcgcgctgattctctcggagaagctgcgattcaatgatgccgaggaacacgcactgctcaccgatctgcacgtcgccttcaaacgcgccaacggctacagcgaactggaaattgcccagaagcgcagcgccatcgaaaacgtcatgaagcccgacagcctcgaagaacaccgcgaacgcctgctggccgccgggttctcgaaagtcgtgccgtggttccagtgtcttaactttgcctcgttgattgccttgccatgattgatctgtcccccctcgcccgccgtctggccggcacgccgctggccgaatgggccaacaccctgcagcgtcaactcgacaagaaaatggacaagggccatggcgatctggagcgctggcagagtgcgctcgatgccttgccgaagattcagccgagcgaagtcgatctgctcaacggcctgaaactcgacaccgattgcgacgacgaaacccgcgcgcagatgcgcactgcgctgatgggcctgtcgccgtggcgcaaagggccgttcgatctgtttggtgtgcacgtcgataccgaatggcgttcggactggaaatggtcgcgcgtagctccacatctcgacctgaagggcaaacgcatcctcgacgtcggttgcggcaacggctattacatgtggcgcatgctcggtgcgggtgcagacagtgtgattggtgttgacccgaactggctgttcttctgccagttccaggccgtgcagcgttacctgtccgaaccaaatgcctggcatttgccgttcccgttcgaagacctgccggcgaatctggaaggtttcgacacggtgttttccatgggcgtgttctaccaccgccgctcgccgatcgagcatttgctggcgctgaaggattgcctggtcaagggtggcgaactggtgctggaaacactggtggtggaaggcgacaagcatcaggtgctgatgccggaagaccgttatgcgcagatgcgtaacgtgtggtttctgccgtcggtgccggcgctggaattgtggttgcgccgtgcggggtttaccgacatccgttgcgtggatgtgagcacgacaacagttgaagagcagcgcggtacggagtggatgaagtatcagtcgttgagcgacttccttgatcccgaagaccacagcaaaaccatcgaaggtctgccggcgccaatgcgtgcggtgatcgtcgcgaagaagtaacccaacctctcaaacaccgcggtgaattcacccctcaccccagccctctccccaaggagagggagccgatctttgggcttttcgaaacttgagttcgactcgataactcaggtccgcggtgatcgcccattcaactcggtcggtcccctctccctctgggagagggttagggtgaggggctttttgctcggcgggcgcggaagaattcagtcagcaccgcaccacactcctccgccaacaccccgccttcatacaacactcggtgattcaaaaagccctgagtaaaaaactgcccctgactctgcacaatccccgccttcggctccagcgcgccgtacaccacccgcgccacccgcgaatgcacgattaatccggcgcacatgctgcacggttccagcgtcacatacagcgtgctgcctggcagacgatagttatccacggcctgtgcggcagcacgaatagcgaccatttccgcgtgggcactcgggtcgctggcgctgatcgggcaattgaagccgcgaccgatgatctcgccatcctgcaccagcaccgcgcccaccggaacttcgccgagggctgcgccttgtgcggcaagcgccaacgcttcacgcatgaaatcgcggtcacggctgcggtcgatgatcgccgctgggcgaatctggcgcatcacttcacctcgatggcggccatcaggccggtttccatgtggtcgatcacatggcagtggaacatccatacccccgggttatcggccaccagcgccacttgcgcgcgctcgttcttgcccaacaggtacgtgtcggtgaagtacggaatgatcttgtgccgattcgacgcaatcactttgaagctcatcccgtgcaagtggatcgggtgctggtactgggtcatgttcttcaattcgaaaatatagctctgacccagcttcaggctggcaatcggccgatccgcacacgtcttgtcggtgatgtcccaggccttgccgttgatctgccacagactcggcggccggccgttatcgacgttcaccgataccgaaccgacccattcgaaattgaagttgagtttctcggcattggccaggtccggctcagccaccgggttggccggcagcgccttcggccagtcagtcggcgcgtcggtattggccaccgaacgcagcgtgcccagacgcaccgggccgttgcgcagcgataattcttcgccagccgctggcgctttgatcgccaggcaaatgcgcatgccggggcccagccagtattccttgcccagcgggcgtggctcgaccgggttgccgtccagcgcataaatccgtgcttcgaccccgggaatattgatgcggtaagtcagggtgttgtcgaggttgagcaaacgcactcgcgtgatctgcccggccggcaattcgatcaccggcgatggcacgccattaattgtcgaaaggcgccccgccgttccgccccgcgccgcttcacgcggaatgctgaactcgacgaaattgcctacgtcatcgatgtgccagttcttcaggctcaaggtcttttcatacacgaaaccggtcggctcgcgctcttcgatgatcagcggcccgaccagcccgcgaccgagctcttcgctgctgctgacgtgcgggtgataccaatagctgccagcatccggcacgcggaatttgtaatcgaagtactcgcctggtagcaccggtagctgcgaaacgtacggcacaccgtccatttccagcggcaggcgaatgccatgccagtgaatggtggtcgccaccggcaaatggttgatgaaacgtacgcgcagccattcaccctgacgcacacgcagctcggttcctggcgccgaggggccgaacgcccaggctgcggttttatgccccggcaccagttcaacatccagcggcgcggcgatcagttcgtaatcgtggcccgcttcagcatcagccattttgcccagccagtaacgcgacgcgccaccggcccccacgccaaccactacaagaccggccagaccaccgagtatttgtcgacgggtaaaagacatgaactcaaccacctcacgtatcagccacgggcgccaggcccgcaaaaggcaaatacgatacacctgcaattgcgaaacagtaagggcggcgcggcggatggacgcagtcgcgcccgcgccatacagcattttgatcgtacccataacataactatgtagtgcacagtccttgagtgaacaggtcatcctgcgacacccgtttctcaaggatagagagcatgaacgcaccaccccccctgcccaatgctgccgacaaggtcgcgcttgaggccattgccgccaccgtcatccagaactgccccagcctgcaggatgaggcgcatcaggtcgccagcgacttactaaaaaaacatgagatcaacggactggatccggatcaggtctactttcatcgcttcgatgcttcgcaaagcagcgccaaagcctttactggctgggagcatgtgcacgcgacgcccacctcgaccatgaccctgaccgaactggtgatccaccgatttcgtgtcgccgatcaggacaatgccgatctacttgacgtgtacggtggtttttataccgcaggcccgggtgccggcaccttcaatgaatccaatgaagtgcgcctgcacggaagcgcggtgctaaaggaattctggagcgtcgacttcagcgcgttgtacagcgaaaaattgacagcattctggagcacctcgaacagccatttccgcacattggccaaatgcaacttcctcgtcaaagccctgcaggcacgagaccaacggcaattgagcgacgaagacttccagttcgtcacgcaagccgtcatcggcccgatcacctggcctgtcagcctgcaaatgctgcaggccgctcacccttgcagcgctgaggtcaccacgttcgatatcgccggttactgcgccatcagtgcgtttcgattcatcacgacgaagggacgacaggtcgtttatctgccaagcgataccgagcctttccaggtactggaaagcgctacagacatgcactactgggtgctgctgcggatgaacaacagcgctacccggcagacattgatgacacatttctccctcgctgaccgccagcaggtcagcgataacctcagcgatctgatgaaccgcctggtgaaaacctggggcgtctacgaccactcaatgatcaatgggcagagccgcgcgatcaagggtgacgcctttacctggttgagcgattcgacccgtgatgccatgttcgcggaagccacgctttccctgacctccaacggcgatctgcgcaagcgactgtggatcggttatctcagcgcaggtgtcaaagtatttggcccgatggcagtggtcggctggccgatagcgcttccagtgatcggcgccagcattgctggcatgggtttgaacatcgatcaggcggtcaacggaaaaaccaccgcgaaacgcaaggccgggatcctcggtgcagtgctcaacggcatcgacatgctgttcaatctcatggtgctcaaagggccgggggcattgctggagaccggccctgaggtcgatgccgcagaagctcgggaaatggccgacttgaccgtagagaacagcgacgagctgaaacgggcactgcccgaaaaaaccttgaagccagtgggttcgccaccgatcggtgttcaaacgccgactgccacatcattactcgaagacatcccgcgaccgccgataccgcaacactggcaagccaatgaattactggaaggactgacgcctggcagtgagcccggcaagcttcaggggatttacctgctcgactccacgccctccacagccatcatgatcgacgactgcgcctactacgtgcgttacgaaaccgacctcaacggtggcggccactgggccatcatcgaccccgcgaaacccgacagttttactggttccatcgccatacgcctgaacgctgagggcgagtgggaaaccatgccacgcggcggtctcaaggggggcggcaagccatctgcgctggcaggatcccgcggtcaacgccaacctgtcccagcaccgataaccaccctgccggcatccgaatacgacgtgcctgcccccctcaaatcgcatcttgagcaaggcgcggcggggctcgacgatgaggcactacgggatgtctacgacagcctcaacgcgttcgatgcctaccgcgatttcaaggtcatcagaaaacgtctctaccacgacgccttggagttctttgccacactgcaattgcctgggcgccctcccgtgccggtactggcgacagacgcgactgccgaggagatcatcgacaggattctgcaacatgcccgagggctggtcatcggtgaaagtcataccgctatcggcagtaaacaatggctgatcgaaaacatggagttactcgccagcaaacaagtgaagaccctgtacatggaacacctgctgaccgactttcaccaggcggccctggacgagttcttccgcaccggcgtcatgcccaaggatctcgagacttacctcaaagcgcttgatgtcggcaacatgactgatccattggagcgttacacgtttcttgaactggtcagggaagccagaaaacaaggcatccatatacaggccattgattgcatggcgagctaccggctctacggcatggagatcatgactgcccaggcgctcacggtcgacgagactgcacggcagaaaatgatgaactacttcgccagatcggtcattcgtgccgatcaggcagcgcggggcgcacacaagtgggtcgctctgatgggcaactcccactcgaacaccttcgacggcgttgccggcgtcagcgagctggaagaggccatcggtatccgtgtcgaggatgtcgccgaaggagtatcacgtggcatcgaagtcgacccggggaaaatcctcccgctgggcggtaccgcgtttgaccgctccgcactggtgcgaggcgacctgcggctgcaaatggaaacaccgtggatcgcacaaaccatggcggaattcgaaacgctgctgccgcgttacggtatgtactccttgaaacaacaacccaacatgacatttatcgtgcatcgcagtcgcagcaaagaactggtgcgcaccattattgaaaatgacgggagacgcttctacatcgaacgcccgagctggccttcggtcagcggtaaacgctatgacagcatcaagacgttgctacaggcactggatgagatgggcatgagcctcgctggctggtcgaaaccgctgtaacgcagacacaaaaaagccgtgtgaaatcgaatttcacacggctttcggtgacagcgctcaagccatcaaggcttgtgcgggatcactcccactcaatggtcgctggcggcttgctcgacacgtcgtaagtgacgcgggagatgccttcgatttcattgatgatgcggccggagacggtttccagcagttcgtaaggcaggtgcgcccaacgtgcggtcatgaagtcgatggtttctacggcacgcagggctacaacccaagcgtaacgacggccatcgcctacaacgccaaccgatttgactggctggaacacgacgaaggcctggctgactttgtggtaccagtcggctttgcgcagttcttcgatgaagatgtggtcggcacgacgcagcagatcggcgtattccttcttcacttcaccgaggatgcgcacgcccaggcccgggcccgggaacgggtgacggtagaccatgtcgtacggcaggcccagctccagacccaaacgacggacttcgtccttgaacagttcgcgcagtggctcgaccagtttcaggttcatctcttccggcaggccgcccacgttgtggtgcgacttgatcacgtgggccttgccgcttttcgcgccagccgactcgatcacgtccgggtagatagtgccctgagcgaggtatttgatgttttccagtttgttcgactgggcatcgaatacgtcgatgaaggtgcgaccgatgatcttgcgcttcttctctggatcggcttcgccggccaggttgtcgaggaactggtcttcagcattggcgcggatcaccttgacgcccatgttctcggcgaacatggccatcacttgctcgccttcgtgcagacgcagcaggccgttgtcgacgaagacgcaggtcagttggtcgccgatggctttgtgcagcagcgcggcaaccaccgaggagtcaacgccgccggacaggcccagcagcacgttgtcggtgccgacttgtgctcggatgttggcgatggcgtcttcagcgatcttcgacggcgtccacaatgcttcacagccgcagatgtcgagaacgaaacgcgacaggatgcgaccgccctgcttggtgtgggtcacttccgggtggaactgcacgccgtagtagccacggtcgtcgttgaacataccggcgatcgggcagcttggggtgctggcgaggatgtggaagtcttccggcatcctggtgaccttgtcaccgtggctcatccatacgtcgaggccgaacaggccgtcggcgtcgatgtggtcttcgatgccatcgagcaggcggctcttgccgactacatcaacgcgggcgtaaccgaactcacgcagttcggaaccttcaaccttgccgcccagttgctcggccatggtttgcatgccgtagcagataccgaagaccggtacgcccagatcgaacactgcctgtgggcagcgcgggctgtcggcgacgtgtacggactcggggccgccggcgaggatgacgcctttaggagcgaattcgcggatcgcatcttcgtccatatcgaacgggtgcagttcgcagtacacaccgatctcgcgcacgcggcgggcgatcagttgggtatattgcgaaccgaagtcgaggatcaggatgcggtgagcgtgaatatcgagggccatgattcagtctcgtctaagtcgttcagaaacagtcgtgattcagaaacaactcggggctgaatcaaacagccccggttgcttactttattgcttgaaggctcaacctacgcggtagtttggcgcttctttggtgatctgcacgtcgtgcacgtgggattcggccatgccagcaccggtgatccgcacgaactcaggcttggtgcgcatttcttcgatgttggcgctaccggtgtagcccatcgaggaacgcagaccgcccatcaactggtgaatgatcgcgctcagggtgcctttgtacggcacacggccttcgatgccttccggaacaagcttctcggcgcctgccgaggagtcctggaagtaacggtcggaggaaccttgagcctgggacatggcgcccagcgaacccatgccgcgataagccttgtacgaacgaccctggaacagttcgatttcgcccggcgcttcttcagtaccggcgaacatcgagcccatcatcacgcaggaagcaccggctacgatggccttggacaggtcaccggagaaacggatgccgccgtcggcgatcaacggcacgccagtgccttcgagggcagcggcgacgttggcgatggcactgatttgcgggacgccgacaccggcgacgatacgggtggtgcagatcgagccagggccgataccgaccttgactgcgtcagcgcctgcttcggccagagccttggcagcggcgccggtggcgatgttgccgccgatcacctgcacttcagggaagttctctttgacccagcgaacgcggtcgatcacacctttggagtgaccgtgagcggtatcaactaccactacgtccacaccggcattgaccagagcggcaacgcggtcaccggtgtctttaccggtaccgacagcagcgccaacgcgcagacgaccttggtcgtccttgctggccagcgggtaggctttggctttttcgatgtcgttgacggtcatcatgcctttgagggcgaatttgtcgtcgacgatcagtacgcgttcgatgcggtttttgtgcaacaactcgcgaacgtcgttcttgtcggcgccttccttgaccgtgaccaggcgctctttaggcgtcatcacttcacggacagtggcttccagacggttttcgaaacgtacgtcacgggaagtgacgatgccgaccaggtcgccatcgtgcaggaccggaacgccggaaatgttgtgcagacgggtcaattcgaacagttcacgcaccgtggcatcagcctcgatggtgattgggtccttgactacaccggcttcgtaacgcttgaccttgcgaacttcggcagcttgctgctcgatggtcatgttcttgtggataatgccgatgccaccttcctgagccatggcaattgccagtcgggcttcagtaacggtgtccattgcagcagaaaccagaggaatattcagctcgatgccacgggttaggcgggtcttgagactgacttcgttaggaagcacctcggaataaccaggcactaggagaatgtcgtcgaatgtcagagcttcttggctgatacgcagcatcgcgggggctcccgagcgggaaaatggaagcgcgccattatagtcagacacccccttcggatcaacgtaaaactcagcttaatatcaatgttgctgatgtacgggaatccccggatctacagctccaccttgacccaagagacaggttgatcgagccagtcggcgaactcgtcgataaagctttgcttgaaaccggcctcaagccagttattgaagatgaaaccgaggttggaaaacccgcattcctgcaaatacagaaagccgttaatgtcatcttcatgcccgcattcggggcaggtgaagttatcggtgcgcccgggaaaccagtcttcgaggctctcgaacagcgcttcgccgacctcgcggcggcactcggcgcaaccggcctcctcgagaaagcccttcgccggggtgtagatgcaacgcttggtgacgatctccaggccgttgattggctctccgaatggcaacgcctgcgggtgcagcaccaccgcgcgtgcgccatcggcaatcgcgtacgccatgcgattgccggtgcggccgcaggtgctcaactcctccttgacgatgttcttgcgtaccagccagcgcaggatcgcccgggcccggggttcatggaccggcagggtggagattttcgggacgatgatgctttgcgaattcatggaaagtcctgcggtgtggctgctgacgccttcgcgagcaggctcgctcccacactttgaatgcattccaactgtgggagcgagcttgctcgcgaagaggccctaaaggccggcagcttaatccctgacgaaatccggtcaagtgctgaggtagcgcccgatcaacgcgagcccgctcgccagcaccagccacgtcaccaatcgcacaaacgcctcgcgcgacaaacgcatggtcaaccgccgcccgatccacaaccccaacgccatggccggcaacagacaaagcgccaacatcaacaagggtagctcggcatacacacccgcgatggcaaacagactcaaacgcaccaccgtgctgcaactgatcaacgcactttgcgtggcccgcgccgcttctttcggcaatcggctgttgagataaatcgcatataaaaagccgccactgccaaacagcgcaccaaacagcccacccaccgtgcccatcggcaccgcccaccccaccgacatttgcgttggccgcgctgttacccacaggctgtaaatcgcataagcgctgataaacagccccatcaacagcagcaatacatcggatttcaggttaagcagaaaaataacgcccaacgtgcaaccgaccgccatgcacggcagcagccgcaacaactcgggcttggccacatcccgccgcgacggcagcagattgccgaacgccgcgacgaaatccagcagcaccagcagcggcacaatcttcgacaacggcatgaacagaatcagaatcggccccgcgaccagcgccgtgccaaatccggcgataccgaacacgatataggccagagcgatacccaagccgatcaacgcccaaccaccggcgccccatgtccactcgctcaacaacgccgccgcactcatgggtctacttccttaataagtctgagatgactttagccagcgtcaagcgttgcgactaatatcttccaggtcgcttactcatctcgaaaaggcatggctcgtgctttcaacccgtcaattgcgttatttcgtcgaaatcgccgactgcggcagtttcagtgcggcggctgatcgtttgtttatcgcgcaatcagcgctgagccggcagatcaaggacatggaaacgcgtctgcaaacgccgctgttcgagcgtacggcgcgccagccccggctcactgcggcgggcgaagcatttttgccgcgcgctcggaatctgctgaacgaactgagcaaggccagcgccatggccactgcggttggcaatggccaacgcggcactttgcgcctgagccattcgagtacggtgacgatcagcggatggcttcttcagcagatcagcacctaccttgatcagcagagcggcgtgtcgctggacatcggcaagttgtcttccgaggcgcaactggaagaactggccgaagggcgcctcgatatcggcctgttgcggttgccggtgttgcgccagcgcgaaggcatccagattgtgccgctgttcactgaacggttgctgctggcggtaccgcacaatcattacctggcaaatgccaacactgtgcaactggtgcaattgaaggacgaggcgtttatctcgatcccgcatccgcaacgcggcggcttgagttatctgtgtgccgacctgtgcatgcgtcagggttttttcccgaaagcggcgcgggtgatgtcgcgcaaaaccacgcagttacagttgattcaggccggattcggcatcgccctgctgccggaatcaatgcaagacattgcaccacgcggcgtacgatttctgccgctgagcgatccggacggcgaaagcaccgtcgccctagcctatcgccagaatccgacacctttgatccaccacttcatcgaaaccttcacaccccccttgtaggagtgagcctgctcgcgatcgcggttgaacattcaacctatcctgcgactgacacaccgctatcgcgagcaggctcactcctacaggggacttgtggtgattcgacggcaaatgcctttaaactgcgccccatgattaaagatccctttgcaagacttggcctggaccgtgaagtcctgaccgtcagccagctcaacggccgtgcgcgggtgttgctcgaagacgtgttcagcaacatctgggtcgaaggcgaaatctccaacctcgcccgcccggcgtccggccacatctatttcaccctcaaggacagcggcgcgcaggtgcgttgcgcgctgttccggcagaacgccgcgcgagtgcgtcaggcgttgaaggacggcctggcagtgaaggtacgcggcaaggtctcgctgttcgagggccgtggcgactatcagttgatcctcgacaccgttgagccggccggtgacggcgcgctacgtctggctttcgatgcactcaaagaaaagctcagcgccgaaggcctgttcagcgccgaacgcaaagtgccgctgcccgcgcatccgcagcgcatcggcatcatcagctcgccgaccggcgcggtgattcgcgacatcatcagcgtgttccgccgccgtgcaccgcaagtacaactgacgctgatcccgaccgccgtgcagggccgcgaagccaccgcgcaaatcgtccgcgcgctgaaaatggccgatgcccgtggcttcgacgcgttgatccttgcccgtggcggcggttcgctggaagacctctggtgcttcaacgaagaagccgtggcccgcgccgttgatgcctgtgtgacgccgattgtcagtgctgtcggccatgaaaccgatgtgtcgatcagtgactttgtcgctgacgtccgagcgccaacgccgtctgcggctgccgagttactcgcgcccgattccagccatttgatccgtcaggtcgaaagtctgcatcgccgtttggtgatgcgcatgcgcgaccgtttgatgcgtgatcgcctgcgtctggaaggcatggcgcgtcgcttgcgtcatcccggcgagcgtctgcgccagcaagcgcaacgtctggacgatctggacatgcgcatgcgtcgtgcgttcgaacgtcatctcaacactcgccgcgaacgcctgattcgcttggaaacccgcctcgccgggcaacatccgggacggcaattggcgatgttgcgccagcgcctcgacagcctcgccgaacgtctgccacgggccatgcgcgaaggcctgaaaaaccgtcgcctgcaactgcacagtcagatgcagacgctgcacgtggtcagcccgctggcaacgctcggccgtggttacagcattctgctcgatgagcgcggccatgcgatccgcaacgccgcgcagacccacactggccagcgcctgaaggccaaactgggcgaaggcgaactgcaagtgcgcgtcgaggacaatcacctgacgcctgtcaccctctctttactggactgatccatgccgcgttttctggctccattgtttctgctctgtctgaccttcaatgcccacgccgacagctacatcactcgactgctgaacaaaccggtgccgggcggcgtcgcggtggttgatctgggcgcggccgcgcaggcgccgaaagccacgtatcagggcaaaccggtgctggtggtgaaagaacagaacaactggctggcgattgtcggcgtgccgttgacggtgaagccgggcgcgcaacagatcagcagtggcgggcgcaatctgccgttcaccgtgggcaacaagaaatacccggaacagcgcatcaccctgaagaacaaacagcaagtaaacccggatcagtcgaacctcaagcgcatcgagggcgaactggccgagcagatcaaggcttaccgcagcttcagcccgaacacgccaagcaatctgctgctggacaaaccggtcaatggaccgctgtcgagcaagtttggcgtgcgccgcttctttaatggtgaggagcgcaatccgcacgccggcctcgacttcgcagtgccggccggaacgccgatcaagaccccggcggcaggcaaggtaatcctcaccggcaactacttcttcaacggcaataccgtgtttgtcgaccatgggcagggctttatcagcatgttctgccacatgtcgaagattgatgtgaaagtcggcgatcaactggcgcggggcacggtggtcggtaaggttggcatgaccggtcgcgcgaccgggccgcacatgcactggaatgtcagcctgaatgatgcgcgggtggatccggcgattttcattggtgcatttcagccttaaaaaatagagcgaagcttatggcctcatcgcgagcaggctcactcctacattggaccggtgttgtgaacacgatcaactgtaggagtgagcctgctcgcgatggcggcttatgctgtactcaaacacttctgacacccctttacccccaattgcgccccaatcaaacctcgcgcaaatatcacaacgatcagcaatctccagcgcaataaaatcccgcaaaaacccgctttacgagtattcctctcaatttttttcgactgcttgccaacctctcccctcgcggttagggttgaaggcatgaaaacctctcacacccttattcagcttcgccagcaccgcagcctgtgccttgtcagcgcacgactgccgggctgaatcgcggcacctcgtcccacgcttttcccagaacattcgtaacaccggcaggccgcctcttttcggcccagacaataaggaatttcccgatgagcatgctcaaagatccgtcttcgaaataccgcgcgtttcctgtcatcaacctgccggatcgcacctggccgtcgaaaaccatcgacaccgcgccgatctggtgcagctccgacctgcgcgacggcaaccagtcactgatcgagccgatggacgcggtgaagaaactgcgtttctggaaaaccctcgtgcaagtcggcgtgaaggaaatcgaagcgtcgttcccagccgcttcgcaaaccgacttcgacttcgtgcgtaccctgatcgaagaaggccacatcccagacgacaccaccattcaggtgctgacccagggccgtgaagacttgatcgagcgcaccttcgaatccctgcgcggcgcgaagaaagccatcgttcacctgtacaacgccacctcgccgtctttccgtcgcatcgttttcaaccaggacaaggacggtatcaaggccatcgccgtgaacgccgccaagctgttcgtcaaatatgcagccatgcagccggacaccgaatggacgtttgaatactcgccggaaaccttcagcgctaccgagctggaattcgccaaggaagtctgtgatgcggtgatcgaggtgtggaacccgacgcctgagcacaagatgatcctcaacctgcccgccaccgttgaatgcgcaacgccgaacatctacgccgaccagatcgagtggttcggccgcaacatcaaccgtcgtgacagcgtgatcatcagcctgcacacccacaacgaccgtggcaccggcgtcgctgccaccgagctgggcctgatggctggcgccgatcgcgtcgaaggctgcctgttcggcaacggcgaacgcaccggtaacgtcgacctcgtcaccgtcgcattgaacatgtacacccagggtctcgacccgcagctggacttctccgacatcgacggcgtgcgtaaagtcgttgaggagtgcaaccagattcaggttcacccgcgccacccgtacgttggcgacctggtgcacacagcgttctccggctcgcaccaggatgcgatccgcaaaggcttctcccaacagaaaccggacgcactgtgggaagtgccgtacttgccgatcgacccggccgacattggccgcagctacgaggcggtgatccgcgtcaacagccagtcgggcaagggcggcatcgcttacttgctggagcaggaatacggcatcagcctgccacgtcgcatgcagatcgaattcagtcaggtcgtgcagcgtgaaaccgaccgtctgggtctggagatgaccgccaagcagatccactcgctgttgatcagcgaatacctgcaagccaacaccccgtacgcgctggtcagccatcgcctgcaggaagaaaacggcaacagcgccgtcgaagtggaagtggcgagcaaaggtcagggcgaaaccaacctgcactggcgtggcaagggcaacggtgcgctggaagcactggtcgccggtctaccggttccggtggagatcatggactacaacgaacacgcgattggcgcaggtaccaacgccaaggcagcggcgtacatcgagctgcgggtgaacggtgaacgtgcggtgcacggcgtgggtatcgatgaaaacatcaccacggccagcttcaaggcgctgttcagcgcactgaaccgctcgctgagccagcctgaggcgaaagcggcgtaagcctttgctgcaatgcaaaaggccccggcgtttaaacgccggggcctttttttgtctgatgcgctcgttcccatgctccgcgtgggaatgcctcaagggacgctccgcgtccagtgacgcggagcgtcacgggctgcattcccacgcagagcgtgggaacgatcagttacctcaggtgaactcgaaggtgtcggcatccagattcgccgggaagcgctcacgataagccgccaatggtgcggcctccaaaaccaccttgaacacgccgtccgcctcccccgccgccagcaaggtttcaccctggaaatccagcacctgactgtcgccggtgtaagcgaaacccttgccgtcggtgccaacgcgattcaccgccgccacatagcagaggttttcgatcgctcgcgctggcaacaggcgattccagtgcagacgtcgcgcacccggccagttggcggtgtacagcagcagatctgtgtcctgcgcatcgcggctccacaccgggaaacgcaggtcgtaacaaatcagcgggcggatacgccagcccttgagttcgaactgcacctgccgttcgccgggggtgtaatggttgtgctcgccggccatgcggaacagatgacgcttgtcgtaatgcagcacttcaccgtccggccgcgcccacaacaggcgattgcgatggctgccgtcagcagcctgaataatcacgctgccggtaatcaccgcatcgagtttcgccgcctgaacgcgcagccatttactggtcggaccgttctcggcttcggcgagcgtttctgactccatggagaaaccggtggtgaacatttccggcaggatgatcagatcagcgccctgtgcctgctccagcaactgctcgaaatgctcgaagttggcctgacggtcgtgccaggccaaagtggtctggatcagcgccagattgagatcgggtaatgcactcagatcacgcatagtttcgccgccgcctcacgcagcgtctcctcgcgtttggcaaagcacaggcgcacgaggcgctggccttcaggtgggttctggtaaaacaccgacaccggaatactcgccacgccgtgttcgcgggtcatccacatggccatctcgacgtcattcaggtcaggacggatctgtgagtaatcgaccagttggaaataggtgccggtgacacgtttgaaggtgaagcgcgacggcgccagcagatcgcagaacagatcgcgcttggcctgatagaaacccggcagcccttcaacgtgctccgggtgctcggccatgtaatcggccaaggcgtattgcagcggtgtcacaccgcagaaactgacgtactggtggactttgcgcagttcggccgtcagcgccggcggcgcgacgacgtagccggtcttccagccggtgacgtgataggtcttgccgaacgagctgaccacgaacgcgcgctgatacagctcttcatgggcgagcacactgacgtgcggcacgccgtcaaacaccaggtgctcgtagacttcgtcgctgatcaggtaaatgtcgcgatcgcggatcagcgctgcgagttgatccagttccgcacgactgatcaacgcgccgcttgggttgtgtggggtgttgatgacgatcattttcgtgcgcgggctcagggccgcggcgagctggtcgaaatcgatggagaaatcttccgggttcaattgcacatgcacgcagcgaccacccgccaactccgtggccggctcgtagctgtcgtagcacggatcgaacacgatgacttcgtcgccgctgtggataaccgcctgaatcgcacagaagatcgcctgggtcgcgcccggtgtgaccgtcacttcgctgtcggcattgacctgcacgccatagctgcgagcgattttcgccgcaatctgctcgcgcaaggccggcaatccggtcatcggcgaatactggttatgaccactggcaatgtgccgaccgaccgcgtcacgcagagactgcgggccgtcaaaatcaggaaaaccctgagacaggttgatcgcgccggtttgcgcggcgagctgagacatctgcgtgaaaatagtgatgccgacattcggcagcttactggtgatcatcgggggttccctgctcaacacccggctctgacgacggcgcgggagagcccgaggatagcccatccggcgcccataaaaaaagggcgctctggtgagcgcccttcttatcgccgaacccatgtaggagctgccgaaggctgcgatcttctgatcttgcctttaaagcaaaatcaaaagatcgcagcctgcggcagctcctacagaagcggttgatcattcccatgcaattgcgggaatggccacctcaatcacttcttgtcgcggcgctttttgtcggctttcttgctgtgcgacatcatccgacgcttcctgttgacctggcggtcggtcagcgtgtttttgttgccttcgtacgggttctcgccgcccttgaactcgatgcggatcggcgtaccgaccagcttcagcacacgacggtaagtattctccagatagcgcacgtacgacttcggcactttctcgatctggttaccgtggatcacgatgatcggcgggttggcaccacccaagtgggcgtagcgcaacttgatccggcggttgttgaccatcggtggcgcgtgctcgccaaccgcatcttccagaatctgggtcagacggttggtcggccagcgggtgaccgccgacttgaacgagttctgcaccgaagcgtagaggttgcccacgccggtgccgtgcagggccgagatgaagtgaatgtcggcgtagtcaacgaagaacaaccgacgctgcaactcgaccttgacgaagtcgcgctcgctcggcgtcatgccgtcccatttgttgatcgcgatcaccagcgcacgacccgactcgatggcgaagcccagcaggttgaggtcgtgatcgaccacaccttcgcgggcgtccatcacaaagatcaccacgttggcgtctttgatcgcttgcagggttttgaccacggagaatttttcgacttcttcgtggatcttgccgcgcttgcgcacaccagcggtgtcgatcagcgtgtacttctcttcattgcgttcgaacggaatgtagatactgtcgcgcgtggtgcccggctggtcgtaaacgataacccggtcttcaccgagcatacggttgaccagcgtcgatttaccgacgttgggacgaccgatgatggcgatcttgatcccgtctttttcgctcgggccaggaatgcgcttggcttcctcgccttcggcaacgatctcttcttcgccgtcttccggctcttcttcgtctttcgggaaatcacccagggcgatttccagcatctgcgtgatgccacggccgtgagcaccggcgatcgggatcgcgtggcccatgcccaatggagcgaactcagcgcgggccatttccgggtcgatgttgtcgaccttgttggccaccacgtaggaacgcttgttacgtttgcgcaggtgttcggcgatcatctggtcggcggcggtgaaaccggccttggcatctaccaggaacagcacaacgtctgcttcttcaatggccagcaacgactgctcggccattttttcgtccataccgtgctcgtcaccggagataccaccggtgtcgaccagaatgtaggaacgcccttgccacttggcctcaccgtactggcgatcacgggtcagaccggacaagtcgccgacaatggcgtcgcgagtcctggtcaggcggttgaacaaggtggacttgccgacgttcggtcggcccaccagggcgattacgggaaccatgcggctctccacttcgttatttcagaaaatacaaaagccgctgcgaggcagcggctggtgctcggggcaacgcctgttagcgctgcaagccccatgaatccggggccgcctgggggtttaaccccaagcatagttgttacttgatggtcagggcttccagtttgccgctgttgccatatacataaatcgtgtcacccaccaccagcggacgggcacgcaggccgtcgctgtcgatgcgctcacggccgacgaaacgaccgtcaacctgactcagcaggtgcagataaccttccaggtcacccactgcaacatagctggagaacacttccggagccgacagttgacggcgagccagcgaatcgttgctccacaatgccgtggtggaacgctcgtcgacgccttcaacggtgcccgaagacaggctcacgtaaacgctgccgaaaccctgagcaataccagcgtagctcgacgcatcgcgctgccagagttgacgaccgctttccaggtccagtgccgcaacgcgaccctgatagctggcaacgtacaaagtaccgccggacagcagcagaccgccgtcgatgtcgaccacgcgctccagttccgaacgaccttgtggaatcgcaatgcgttgttcccagaccggcacgccgttggaaatgtccagagcaaccactttaccggtcgacaggccagccaccgcgaggcggttggtcaccagcggggcactggtgccacgcagggtcagtacggccggggtgctgtcatacacccagcgctgagtaccggtcgatgcatccagaccgatcagacgatcgtcctgagtctgcacaaccaccacgtcaccgttgttggccggtggcgcgaggacttcgctgttgacgcgagcgcgccacttctcttcaccgttgctggtgtccagagcgacgacttcgccgcgcagggtgccgatcagaaccagaccgtaacccacgccaacggcgccggagacaggcaggtcaagatcctgcttccatttcacgtcgccattgccacgatccatggccatcaccacgccggtcacatcggcggcgtagatggtgtcaccgtcgatcgccggtaccagcatgttgtaggtttcgccctgaccgtcaccgatcgaacgactccactgcttgtgcagaaccacttcttctttgaagtcggtcagttcagccggtggcaattctttcttgctgttgctgctgcaacccgcggccagaagggccagagccagcaatgctgcatgcttccaacggatcacgtcacgcatcccctttggccaggtcgtcgagcttgatttgaaggccaccgactgccgcttcatccgacagtgccgccttggctttttgatacgccttgttcgcgtcatcggtacggcccaactgcaccagcaggtcgcccttgagttcttcgcgagtcgccaggaacgctttgtcggcgtcgccgtcgagcagtttcagggcatcttcagccttgttctgtgcgccgagtacctgcgccagacgctgacgggcgatttcgcccagcgccgggttggccggtttgtcgacgatggctttcagctcggtcgcggcgtcgtccagcttgccgctgtccacagccactttggccacgaacaggctgccgtactgcgcataggcagaaccgccgaactcgctgttgagcttgccggccaagtccgcaacgcgggcggcatcaggcttgccgtcaggcgtcagcgtggtttccagcaattgctgatagagcaccgaggcgccttgcgactggttgctctggtatttgtgatatgcctgccagccgaacacgatgaccagcgccaacaggccgccggtgaccagaggtttgccgttgcgtgtccaccagtccttcaaatccgccaactgttcgtcttcggtactcgacaccccaatactccttaatcgctaaatcggctgtttggacagcttcaaccctgcacgacgcaggtggccaggtgagcggcgagcgcatcccaggcaatgctttgttgttcgccctggccacgcaggggtttgaaacctaccacttgctgggccatttcgtcgtcaccgaggatcagtgcgtacagcgcaccgctcttgtcggccttcttgaactggcttttgaagctgccggcgccggcattgacttgcaggcgcaggtttggaagttgatcacgaacacgttctgccagggccagaccggccagctcggcttcttcaccgaaggcgcagaggtagacatcgacctgacgggagatttcttccgggatctgctccagggtttcgagcatcaacaccagacgctcgatgcccatggcgaaaccgacgccagtggtcggcttgccgcccatctgctcgaccagaccgtcgtaacggccgccggcgcagacagtgccctgggcgccgagcttgtcggtgacccattcgaaaacggttttgctgtagtaatcgaggccgcgcaccagtttcgggttgagcacgtacggaatgccgacggcatccagacgcgatttcaaaccttcgaagtgcgcacgggattcgtcgtcgaggtagtcggccattttcggcgcatcgaccagcactgcttgggtgtcggcatttttcgtgtcgagcacgcgcagcgggttggttttcaggcgacgctggctgtcttcgtcgagcttgtcgtggtgcgccgagaggtactcgaccagcgcttcacggtagcgaccacgggactcgctggtgccgaggctgttgagttcgagtttgaccgcatcacgaatgcccagctcgccccacaggcgccaggtcatgatgatcagttcggcgtcgatatccggaccgtcgaggttgaacacctccagaccgatctggtggaactggcgataacggcctttctgcggacgctcgtggcggaacatcgggccgatgtaccagagtttctgcacctggccaccgccggtaatgccgtgctcaagtacagcacgcacgcacgccgccgtgccttccggacgcagggtcagggagtcgccgttgcggtcttcgaaggtatacatctctttttcgacgatgtcggtcacttcaccgatcgagcgcttgaacagctcggtgaactcgacgatcggcatgcggatctgcttgtaaccgtagttatccagcagacgtgcgacagtgccctcgaaataacgccacaggggggtctgttcgggcaggatgtcgttcatgccacgaatggcttgcaatgacttgctcactttaaatccttaaattcgttcggctcttcagtcagggtcagccgcgcgcaattacggcagcgtcagcttcgaccttttcggccgctttctggcggatcagcctttccagctcgtccaccagattgtcattcgtcagtttctgcgccggcttgccgtcgatgtaaatcaggtttggcgtgccgccggtcaagccgatatgggcttccttggcttcgccggggccgttgaccacgcaaccgatcaccgcgacatccagcggcaccagcaggtcttcaaggcgcccttccagctcgttcatggttttcaccacatcgaagttctgccgcgagcagctcgggcaggcgatgaagttgatgccacgggaacgcagatgcaaagacttgagaatgtcgtaaccgaccttcacttcctcgaccggatcggccgccagcgagatgcggatagtatcgccaatcccctcggcgagcagcatacctaggcccacggcggatttcactgtgcccgaacgcaatccaccggcttcggtgatgcccaagtgcagcggctgaacgatttctttcgccagcaagcggtaggcttcgacggccatgaacacgtcggaagccttcacgctgaccttgaagtcctggaaattcaggcgttcgaggtgttcaacgtggcgcaaagcagattcgaccagcgccgctggcgtcggctcgccgtatttcttctgcaggtctttttccagcgaaccggcgttgacgccgatgcggatcggaattccgcgatcacgcgctgcatcgaccaccgcacgaacacggtcttcacgaccgatgttgcccgggttgatacgcaggcaatccacacccagctcagcgactcgcaaagcaatcttgtagtcgaagtggatgtcggcaaccagcggcaccttgaccagttgcttgattttgccgaaagcctcggcggcgtccatgtccggcaccgaaacgcggacgatatcgacgccagcggcttccagacgattgatttgcgcaacggtggcggcaacgtcattggtgtcgctgttggtcatgctctgcaccgcgatcggcgcatcgccgcccaccggtacgttgccgacccagatcttgcgcgaaacgcgacgtttgattggagattcgccgtgcatgacttattgacccaacttcaggcgagcagtctcgccactggtgaacggagcgatatcgaccggctggccgttgtagctgacctgcgcggcacgggctacgccgagacgcacgttaagcggcggcttgccggaaacgctgacgctatcgcctttatgcttgagaccactgaagatcactttgccacgaccgtcggtcacttgtgcccagcaatcggcgctgaactgcagttgtacctgaccatcgccagcaactggtgcgaccgcttctgcgggggctgccggagcagcaggaacaaccggcgcggtaacggtcggcgctggagtggccggcgcgtttggcgctggggtagccggagtagcaacaaccggtgccggcgtatgaaccggggcggtcggcgttgcagccggagcagttggagtggttgccggagcagcgccttcggcaccggtcgattcagccgtggtttcggactgaggcaacgccagtgtcgtcgaagtgtcagcctgattttcctcgactgcctggtcttccggctcatcgatcgggtgaatctgggtcgtaccgtcggcaccttcgacttcaacgtgctcaggcgccagagacgtcagatccttggtgcgcagcgaggtctgatcctgccaccagacgaaaccaccgccgatgaccgcaatcagcaacaacaggctgacgatccgcaaaatggtgtgggagacccgcaccggctcttcgatacggccgagggcgtgaacattgctgccttgggaatcggtaccggtggattggtcgaactgctggaccagaacggtctggtccatgccgagcaatttggcataggcgcgaatataaccgcgagcgaaggtatgccccggcagcttgtcgaaagcgccggcttcaagattgctcagggaagtcacggtgaggttgagcttgagggccacttcggccagcgaccagccattgctttcgcgggcctggcgcagggtctcaccggggttaacgcgattcgctgctacaacttcgggatgcgccgctttcatcattgctccgacaggtattgctgatattccggcgtaccgggatagagtcgttttaattgcaggccataactggcggccttgtcgcgatcttcaaacacttttgccagccgaacgccgagcaatagactacgtgcattttgttcggtgagcaggctgaaacggtcgtaatagtcacgcgcgggcacataatgcctgtcttcgaaggacaactcagccatttccagcaatgcgcgcggttgttgacggttcaaacgcagtgccttttccagctgttgctgcgccagatcacgctgaccgagcttcgcggccgtcatgccgaggttctcgaacacacgcgaacgctcaggatacagggtatcggcggcggcctgttcaaaacgctcgtaggcttctttataacgctgttgttcgtagagaaaactgccgtagttgttgaggatgcgcgcatcggcaggacgggaggacaaagccttgcggaagtgttcgtcggccagctcaggctccatttcagactggaacaccaagccgagggccgcattggcatccggatcggaaccgtcgatctccagtgccttcttcagcggcaccttggcccgctcgctcatgccttgctgcaagtatcccagccccagctgcacgtaggcagcccgcgcttcatcgcggcccttgctggtcttcatcgggttgtagtcacccgacaggacacaaccagcacacaggctggccaacagcaacagcagcgcaaagcgcagggacatagagatcctctcttagttagtgttcgcggcgttctgtgccagatcgctgtcggcgctcaactcacgcacggcgatataacgttcgctgcgacgggtgcgatccagcacctgccctaccaattgaccacatgcagcgtcgatgtcttcaccacgggtggtgcggacagtgacgttgaaaccggcctgatgcaactgatcctggaaacgacggatcgcgttgttgctcgggcgctcgtacccggaatgcgggaacgggttgaacggaatcaggttgatcttgcacggaatattcttcagtagctcgatcatctcaacggcgtgttcaactttatcgttgatgtccttgagcaaggtgtactcgatggtcagcacgcgtttttcgcccagggacgacatgtagcgctggcacgactcgagcagcatcttaagcggatatttcttgttgatcggcaccaattggttacgcaatgcgtcattcggtgcgtgcagggacaacgccagggacacgtcgatgtgcttggccagctcatcgatcatcggcaccacgcccgaagtggacagggtcacgcggcgcttggagatcccgtagccgaggtcatccatcatcagatgcatggcggcgacgacgttgtcgaagttcagcagcggctcacccatgcccatcatcaccacgttggtgatggcacggtcgacggttgccgggacactgccgaaagatttgttggcaatccacacctgaccgatgacttcggcggcggtgaggttgctattgaagccttgcttgccggtggagcagaaactgcaatccagggcacagcctgcctgggacgaaacgcataatgtgccgcgcttgccctggggaatgtacacggtctcgacgcagctgccggacgccacgcgcaccacccatttacgggtgccgtcgctggagatgtcctcgctgaccacttccggaccacggacctcagcaataaccttgagcttgtcgcgcaaggccttgctgacgttcgtcatggcgtcgaaatcatcgacaccaaagtggtgaatccatttcattacctgaccggcacggaaacgcttctccccgattgagtcgaagaatttttccatttcctgttgagtcagacccagcaggttggtttttacagtcgatgtagtcatggattcaccttcactcttaagccaatgcttagcgagtggttacttcagtagctgcgaagaagtacgagatttcacgagcagctgcggcttcggagtccgaaccgtgaacagcgttggcgtcgatggaatcagcgaagtcagcgcggatggtgccggcagcagcttctttagggttggtagcgcccatcagctcacggttcagagcgatagcgttttcgccttccagaacctgaacaacaacaggaccggagatcatgaaagcaaccaggtcgccgaagaaaccacgagcgctgtgctcagcgtagaagccttcagcttcggctttggacagttgcttcagtttcgaagctacaacgcgcaggccggctttttcgaaacgagtggtgatttcgccgatgacgttttttgcaacagcgtcaggcttgatgatggagaaagtgcgttgaacagccatggtgtaactccagaaacggtaatttgcgaaaaattaaacccgcgaattatacgcgggttcttgggtattgcctaacctgcgaggacgatcagtccaattcttcagcccagagcgtctgaaccgcttccaacaccttctcgccaacacgaccagaggtattgtcaaaatccggcagctctttgatccattgctgcagatcgacgaaattgacagaaaacgggtctacgcccggcttggcctcggccaactcttctgcaatacgttgaacatcattccaaccgtagctcatgacagtcttaccagtcagtgcggcgcttcggccgcatggttaagcgaatatttcggaatctcgacggtgatgtcttcttcaccaacgatagcctggcaagccagacgcgattgcgcttccagaccccaggcacgatcaaggaagtcttcttccagctcgtcagcctcttccatcgagtcgaaaccctcacggatgatgcagtgacaagtggtgcaagcacacacgccgccgcaagcactttccatctcgatgtggtgttcgtgggccagttcgagaatcgaagtgccaggcgcagcgtcgaccaccataccctcagggcagaacttctcgtggggcagaaaaatgacctgcggcatcagatatcctcgatttcattcagattgcgccccgacagagcggctttcaccgtcagatccatgcggcgggcagcaaaggcatcggtcacttgcgacagacgcttggtctgctgctcgatggcataaccatcagtacctttcatcagttcggccagctcctgcagttgcaggtcgataaccatgcgctcttcggcgtcgagcaaccgctcgccatcaacctcaagagcgccctgcaccgcttcgatcaggcgctgggcatcgacttgctgctcgcgcagaacgcgggcgaccttgtcgtcattggcgtgctggaacgaatccttgagcattttggcgatttcgccgtcggtcagaccgtaagacggcttgacctgaatgctcgcctcaacgcctgaacccaattcacgggcagaaacactgagcagaccgtcggcatcgacctggaaggtcacgcgaattttcgccgcaccggcgaccatcgctggaatgccgcgcaattcaaagcgcgccagcgaacggcaatcactgatcagctcgcgctcaccctgcaggacgtggatagccatggccgactgaccgtctttataagtcgtaaaatcttgtgcgcgagcgacggggatggtggtgttgcgcggaatcaccttctccatcaggccacccatggtttccagccccagggacagcggaataacgtcgagcagcagcagttcgccgccatcgcgcttgttgccagccagcgtatcagcctggatcgcggcgccgatggccaccacttgatccggatcgatttcagtcagcggctgacgaccgaaggcttcggcaacggcttcgcgaacacgcggcacgcgcgtcgaaccgccgaccatgaccacagcgtgtacgtcgtccagctcgataccggaatcgcgaacggcgcggcggcaggctttcaggctgcgtgcgaccattggctcgatcagcgcatcgaaggcttcgcgggtcaacggcgctttccagtcgccataggccacttcaacgctggccgcatcggtcagggcttctttggccgcgcaagcggtttgcagcagattgcgttgtgcgcccggatcgagatcggcggacagaccggcgctctcgatgatccagccggcaatcgcgtgatcgaagtcgtcaccacccagcgcgctgtcgccgccagtggccagaacttcgaaaacaccgccggtcagacgcagaatcgaaatatcgaaagtaccgccgcccaagtcataaatcgcgaccaggccttcagcgtgttgatccagaccgtacgccacagcggctgcggtcggctcattgagcagacgcaacacattcagaccggcgagcttggccgcatctttggtggcctgacgctgagcatcgtcgaaatacgccggaacggtgatcaccgcgccgaccagttcgccacccaacgtcgcttcagcacgctgacgcaggactttgaggatgtcggcagaaacttcgaccgggcttttcgggccctgcacggtgtcgatgaacggcatgtgcgattcgccgccgacaaagcggtacggcagttgctcgcccaattgcttgacgtcggacagaccacgacccatcaagcgcttgaccgacagcacagtgttcaaaggatcggaagacgcagccagcttggccgactcgccgacttcgacgcgatcggcgtggtaacgcacggcggacggcaggatgacctgcccgttggcgtcggccagcggctcggaaagaccactgcgcaacgcagcgaccagcgaattggtagtgcccaggtcgatacccacagccaggcgacgctggtgcggttgaggactttggccgggttcggcgatctgcagtagagccatggtaatcaggtcttgtctgtctatcaggcgtgcattcagggcagcactgggttaatcgtcgaggcgctcttctaactggcgcacttcgtaggtgagcttgtcgaggaactgcatgcgccgcatcaggcgttcagcctgttcgcgttgcgctgcatcatcccaacaggctgcgaagctttcgttgagttcttcctgagccactttcagacgacgcttgaataccgcgacaccgtcgaggtcggcactgtcctgaaggtcttcgagctcttcgcgccattgcatctgctgcaaaagaaactcgggatcatggacagtgacttccatcggcacttcatgcccgctgatggtcagcaggtagcgtgcgcgctggaccggactcttgagcgtctgataggcgtcgttgagccgcgcagactgctcgagtgccgtgcgctgttcacgctcggaagcgtcggcgaagcggtcaggatgaacgccgcgcgccaactcgcgatagcgcgtggccaactgctcgagatccagacggaaacccggttgcagctcgaataaagcgaaatgacaaggaatacccacgacaagcctcagatgttgaagctttcgccgcagccacattcaccgcgtacgttggggttgttgaacttgaagccttcgttcaacccttccttgacgaagtcgagctcggtgccgtccaggtaggcgaggcttttcgggtcgatgatcactttttcgccgtgactctcgaacacctgatcctctgcaaccacctcgtcgacaaactccagcacgtaggcaaggccggaacagcccgtggtgcgaacacccagacgaatcccttcacctttgccgcgcccatcgagggagcgccgcacgtgtcgagcagccgcttctgtcatgctgatagccatcggtgactccttactcgtcgccaaatccagaaagtcagatcaagcctttcttctgcttgtaatcgcgaacagccgctttgatagcgtcttcagccagtaccgagcagtgaattttcactggtggcagagccagttcttcggccagctgggtgttcttgatggtttcggcttcgtccagggtcttgcccttcatccactcggtggcgagggagctggaagcgatggccgaaccgcagccgtaggtcttgaacttggcatcttcgatgatgccagcgtcgttgaccttgatttgcagacgcattacgtcgccgcacgccggagcgccgaccatgccggtgccgacatcaggatcttccgcgttcatcttgccgacgttgcgcgggttttcgtagtggtcgatgaccttttcgctgtaagccatgattcttaatcctcactcatcagggccgctcttcagccctgcaactgcgctgcgtaaaccgccgcgtcgctacaggatctgtatccggcggcttctatatttagtgtgccgcccactcgattttcgagatatcgacgccgtctttgtacatgtcccacagcggcgacagagcgcgcagcttggtaacggcctcgcagactttctgcgcggcgtagtcgatttcttcttcggtagtgaaacggccgaaggtgaagcggatcgagctgtgtgccagttcgtcgttgcggcccagggcgcgcagtacgtacgaaggctccaaggacgccgaggtgcaggccgaaccggacgacactgccagatccttgagcgccatgatcagcgactcgccttcaacgtagttgaagctcaggttcaggttgtgcggaacgcgggcggtcaggctgccgttgacgtacagctcttccagatgctcgacctgcttgtagaagcggtcgctcaacgctttgatacggacgttttcggcagccatgtcttctttggctacgcggaacgcttcgcccatgccgacgatctggtgggtcgccagggtgccggaacgcatgccacgctcgtgaccgccgccgtgcatggtcgcttcgatgcgcacacgcggcttgcggctgacgtacagcgcgccgatgcctttagggccgtaggtcttgtgagcggagaacgacatcatgtcgactttcagtttctgcaggtcgatctcgaccttgccagtggactgagcggcgtcgacgtggaacaggatgcccttggcgcggagcatttcgccgatagcagcaatgtcgttgacggtgccgatttcgttgttcacgtgcatcacggagaccaggatggtgtcttcgcgcagtgcagcttcaatcatggccggagtgatcaggccgtcttcggtcggctcgaggtaggtcacttcgaaaccttcacgctccagttggcgcatggtgtcgaggacagccttgtgctcaatcttcgaggtgatcaggtgcttgcccttggagccgtagaaatgcgccgcacccttgatagccaggttgtcggattcggtagcgccggaggtccagacgatttcgcgcgggtcggcgttgaccagatcggccacctgacgacgggcgttttcgacggactcttcagctttccagccaaacacgtgggaacgggacgccgggttaccgaagtttccgtcgaccagcaggcattcactcattttttgcgcaacgcgcggatcgaccggggtggtcgcagagtaatcaaggtaaatcggcaatttcatggactatctcctaaatcagggctggcgtaccgctagctcttcggctgtcattcgacggcggacgcttcaatcttgtccaggcgtggcgccttgctgttgcaacggcgctggtcctgacgctgggctacttcttgcacctcacggcgagttacaagatcagccaagctgataccacttagaaattcgtgaatctgcaggctcagatcgcaccacagatggtgggtcaggcaggtgtcgccggaatggcaatcgccctggccctggcacttggtggcatcaaccgattcgtttactgcatcgatcacctgggcgacctgaatgccctgcatgtcgcgggacaattggtagccgccacccggaccgcgaacactggaaaccaggttgctgcggcgcagcttggcgaacagctgctcgaggtaagacagggagatgccttggcgctcggagatatcggccagggacacgggcccgtgctgcgcgtgcaacgccaggtcaagcatggcggtcacggcgtatcggccttttgtagtcagtcgcatggacagttaccacggagttcagaatggggcgagtatgcaattcccgagtatttaagtcaactttaagacctagtactttagtcaggattacccgcaaaagagcgcgcgaatgatagcagggtctgcggcctaatggcacaccggccggcgcaagcttctgtaggagctgccgcaggctgcgatcttttgattttgctctatagaagatcaagggatcgcagccttcggcagctcctacacagggcttagctggctttggactcgtctttgcctttgacgcaggcgaagtcttcttcacgcagttcaggcagatctttcgcacaataattgctgccaagatccttcagcgcaccacacatcccttccagccgtccgtccaccgcttgcaggtgatcgagcaactgaccgatggcgcgcgccaccgggtcgggcatgtcttcgctgacgccataggcatcgaagccgatcttctcggccatggccttgcgcttggcgtcctgctcctcgtcagacttgacgatgatccgccccggaataccgacaactgtggcgcccggcggcacttctttggtcactacagcgttggaaccaaccttggcgccggcgccgaccgtgaacgggccaagcaccttggcgccagcccccacaaccacaccatcacccaacgtcgggtgacgcttgcctttgttccagctggtgccacccagagttacaccctgataaatggtcacgtcatcgccaatctcggcggtttcaccgatgacgatgcccatgccgtggtcgataaagaagcgtcgaccgactttggcgcccggatgaatctcgatgccggtcaaccagcgtccgaagttcgacaccagccgcgccagccatttcagctcgttacgccagagcatgccggccaatcgatgaatccagatggcatgcatgccggggtagcaggtcaggacttcaaaagcgttacgcgccgccgggtctcgatggaaaacgctctggatatcttcacgcaaacgctcaaacatcatttagtccttccgcttaagaagctcaccacgggccgccttctgggtttccgtgaggatgccacgcaaaatattcatttccgcccggctgaccgagctgcgtccatacaaccggcgcaggcgcgccatcaagtgccgtggtttttccggatcgaggaattcgatggcgaccagcgtctgctccaagtgctcataaaagcgctccagctcatccatggtcgccagctcggcgcttttcaccgaggccacttcttctttctcgatcttgctcggctgaccttgtgcagccagccaggccatgcgcacttcgtagctcaacacctgcaccgccgcgccgaggttcagcgagctgaactccggatcggaggggatgtgcacgtgaaagtgacatcgctgcagctcttcgttggtcaggccggaatcttcacgaccgaacaccagcgcaatttcagcgccctgcccggcttcctcgaccactttggtgccgcactcgcgagggtccagcagtggccaggggattcgacgatcacgggcgctggtgccaagcaccagattgcagccgaccaaggcgtcttccaaggtggcgacgacttgtgcgctttcaagaatgtcaccggcaccggaggcgcgagcatcggcctcgtggtgtggaaacaggcgcggttcgaccagcaccaatcgcgacagacccatgtttttcatggcgcgcgcggccccgccgatgttgccggggtggctggtattgaccaggacgacacgaatgttctgcagcaagggaggcgctctcggacacaggaaaggggtgcaaatcttacagaacagcctaccgttaagctatgaaagcgaacagcgtccttcacctgaagaaaagttctgatagaatgcgcggctttctttaacaaccttaggtgacacatccatgcagcccatgctgaatatcgcgctgcgcgccgcccgcagcgccagtgaactgatcttccgctccatcgagcgcctggataccatcaaggtcgacgaaaaagacgccaaggattatgtatccgaggttgatcgcgccgctgaacagaaaatcatcgacgcgctgcgcaaggcttacccgaaccactcgatccgcggtgaagagactggcctgcacgccggtaccggcatcgaaggcgaagagtacctgtggatcatcgatccgctggacggcaccaccaacttcctgcgcggcattcctcacttcgctgtcagcattgcctgcaagtaccgtggtcgcctggagcacgcagtggttctggatccggttcgccaggaagaattcaccgccagccgtggtcgcggcgctcaactgaacggtcgtcgtctgcgcgtcagcggtcgtaccagcctcgacggcgccctgctgggtaccggcttcccgttccgtgacgatcaaatggacaacctggaaaactacctgggcatgttccgcgccctggttggccagactgccggcatccgtcgcgctggctcggcgagcctggacctggcttacgtggctgctggtcgcttcgatgcgttctgggagtcgggtctgtccgagtgggacatggctgcaggcgccctgctgattcaagaagccggcggcctggtgagcgacttcaccggcggtcacgacttccttgaaaaaggccacatcgttgccggcaacaccaaatgcttcaaggcagttctgacggcgatccagccgcacctgccggcttcgctaaagcgctaagcgtcacgcgaaacgaaaaaagcacccttcggggtgctttttttatgcctggaattcatcacgcaccacaccactataccaatgtaggagtgagcctgctcgcgatagcggtgcatcagccaccacctgcatcgaatgataaatagctatcgcgagcaggctcactcctacaggggatttgttgcgtggcttgaatggcgggcacaaaaaagcaccccgcagggtgcttcttgttaaaacagtcggtacttactgagccggctcattctgcgacagaatcagcttgccttccttgtcgaccggaatctggttgcccggatcgcgatccatccgcactttgccttccttgccatcaagcgagtaacgcacgtcgtaaccgacgaccttgtcactgatgtcattgaccgtgttgcagcgcgtctgcgtggtggtgtaggtgtcacgctcttgcatgccttcctgcaccttgttacccgcataaccgccaccgaccgcaccggctaccgtggcaattttcttgccggtgccgccgccaatctgattacccagcaaaccacctgccagcgcaccaacgacagtaccggcaatctggtgctgatcttttaccggtgcctgacgagtcactgccacgtccttgcacacttcacgtggagtcttgatctgtgttttaaccggctcaacggccaacacttgcgcatactcagggccgcttttaaccaggctgtaggtggcaacagcacccccggcagtcacaccgacagcacccaataccgcaccaaccagtaacgacttgttcacatgaacctcctgaccatcacatgcgggacgcgcccgcgcttctcccagccttggagcataaaaaaaggcgcgagttcaactcgcgcctttcttgggctgacagccggggaagcgatggccgttatggacggtcgtcgacttccttctcggtattggccggaggaatcagatcctcggtggtcaggttcagccagatcagcaccacgttcgcgatgtagatcgacgagtaagtacccgccagaacaccgatgaacagggcgatggagaagccgaacaggttgtcaccgccgaagaacagcagtgccgcgatcgccagcaaagtggagatcgacgtcgccatggtccgcaacaacgtctgggtggtcgagatattgatgttctcgatcagcgttgccttgcgcaggacacggaagttctcacgaacccggtcgaataccacgatggtgtcgttcagcgagtaaccgatgatcgccagcaccgccgccagcacggtcagatcgaaagtgatctggaagtacgacaggataccgatggttacgatcacgtcgtgaatcagcgaaacgatggcgccgaccgcgaacttccactgaaagcggaaagccaggtagatcaggataccgccgagcgccagcagcatgccgaggccgccctggtcgcgcagctcttcaccgacctgcgggccgacgaactcgacacgcttgaccgtcgccgggttgtcgccaccgactttctgcagagcttgcgctacttgatggcccaactgcgggtcttcacccggcatgcgcaccagcagatcggtggtcgcaccgaagttctgcacgatcgcttcgtgataaccggaggtagccagttgctcacgcactttggtgacatcggccggacgctcgtaggtcagctcgatgagcgtaccgccggtgaagtccagaccccagttcatgcccttggtagcgacactgaacatagccagcaacgtgagaaacactgtgacgccgaacgcgaagttgcgaacgcccatgaagttgattgtacgtaacatggcagccccttaaatccacaacttcttgaagtcacgtccgccaaagatcaggttgaccattgcgcgggtcaccatgatggccgtgaacatcgaggtaaagatcccgagggacatggtcaccgcgaaacctttgaccgggccggtgcccatggcaaagagaatcccgccgaccagcaaggtagtcaggttggcgtcgagaatcgcggtgaatgcccggccgaagccttcgttgattgcacgctgcacggtcatgccggcggcgatctcttcacggatccgcgagaagatcagcacgttggcgtcgaccgccatacccatggtcaacacgataccggcgatacccggcagggtcagtgttgcacccagcagcgacatcagcgccagcagcaagaccatgttcaccgccagtgcgacggtggcaatgatgccgaagaaacggtagatggcgatgatgaacagcgacacgaacagcatgccccacagcgacgcatcgatacctttggtgatgttgtcagcacccaggctcgggccgatggtgcgctcttcagcgaagtacatcggtgcagccagaccaccggcacgcagcagcagcgccagttcggacgattcgccctgaccgttcaggccagtgatgcggaactgagcacccagcggcgactgaatggtcgccaggctgatgatcttcttctcttctttgaacgtttgcaccgcgacgtctttttcgacgccgtcgaccacttgcttggtgtaagtggtaatcgggcgttgttcgatgaagatcaccgccatgctgcgaccaacgttcgaacgggttgcgcggctcatcagttcaccgccgtgaccatccagacggatgttcacttcaggtgtgccgtgctcgccgaaaccggccttggcgtcggtcacctggtcaccggtgatgatcagaccacgctcgatctgcgcaggaggacgattgccttcacggaactcgaaagtctcggacgtggctttcgaagcacccggctctgcagccagacggaactcaaggttggccgtcttgccgagaatacgcttggcttcggcagtgtcctgcacgcccggcagctcaaccacgatgcggttggcgccctgacgctggacgatcggttcggcaacacccagctcgttgacgcggttacgtaccgtggtcaagttctgcttgatggagtattcacggatttccgccagcttggccggggtcatcgccagacgcagtaccggttgaccgttgaggtcggccggaacaatgtcgaaatcgttgaagttcttgcggaccagcgcacgggcctgttcacgggagtcttcatcgctgaagcccaactgaatggcaccattgagctgcggcaggctgcgataacgcagtttctctttgcgcagcaggctcttgacgtcgccttcgtagactttcaggcgtgcatcgagagctttgtccatgtccacttccagcaggaagtgcacaccaccggacaagtccagacccagcttcatcgggtgcgcgcccagattgcgcagccattgcggggtggtctgtgccaggttcagcgcgacgacgtagtcatcacccaacgccttgcgcactacgtctttggccggcagctgatcttcagccttgctcagacggatcagaccgcccttgccatttgccgccagtgtggccgccttgacgttgatgccggactctttgagcgcggtgcttacgcgatccagatcggcctgattgacctgcagagccgtgctggcgccgctgatctgaatggccgggtcatcggggtatagattcggagcagaataaatcagaccgaccgccagcaccgccaggatcagaatgtatttccacagaggatatttgttcagcatcacgccgcccgttatgacgcggggcgccttgcgcgccccgtcgattgagtagaagttgttgctcttagatcgctttcagcgtgccttttggcagcgtggcggcgatggcgcctttctggaatttcatttcgacggtgtcggaaacttccagaaccacgaagtcatcggctactttggtgatcttgccggcgatgccgccagtggtcacaacttcgtcgcctttctgcaggctgctcagcaggttcttctgctctttggcgcgcttggcctgtggacgccagatcatcaggtagaaaatgaccaggaagccgaccaggaaaatccactcgaaaccaccgcccatagggccggcagcagccggtgcagccgcgtcagccatggcgttagagataaaaaagctcatttagcactccagttgcaaatgttgaatcttggggtcagaaaactcagtccaaaggcggaacgggaagtccgcgtttggcgtagaaggcatcgacaaaggcggccaatgtaccctgttgaatagcctcgcgcaaaccagccatcagcacctgataatggcgcaagttgtggatggtattgagcatgcttcccagcatttcgccgcacttgtccagatgatgcagataagcgcgcgagaagttctggcaggtatagcaatcgcaggtcggatccagcggcgattcatcatggcgatggaacgcgttacggatcttcagcacgcctgtatcaatgaacagatgcccattgcgggcattacgggttggcatcacgcaatcgaacatgtccacaccgcggcgcacaccctcaaccagatcttccggtttgccaacgcccataaggtaacgaggtttgtcagccggcatcatgcccggcagataatccaatactttgatcatctcgtgcttcggctcgcccaccgacagaccgccaatggccaggccatcgaagccgatcttgtcgaggccttccagcgagcgcatgcgcagatcctggtgcatgccaccctgcacgataccgaacagtgccgcagagttttcaccgtgagcatttttcgaacgctgagcccagcgcagcgacaattccatcgaaacgcgcgcgacatcttcgtcagccgggtacggcgtgcattcgtcgaaaatcatcacgatgtcggagccgagatcgcgctgcacctgcatcgattcttccggccccatgaacactttggcgccgtcgaccggggaggcgaaggtcacgccctcctccttgatcttgcgcatcgcgcccaggctgaacacctggaaaccaccggagtcagtcaggatcgggcctttccactgcatgaaatcgtgcaggtcgccgtgttccttgatcacttgggtgccaggacgcagccacaggtggaaggtgttgcccagaatgatttctgcgccagtggcgacgatgtcacgcggcaacatgcccttgaccgtgccgtaagtgcccaccggcatgaacgccggggtctcgacggtgccacgagggaaggtcagacgaccacgacgggccttgccatcggtggcaaggagctcaaaggacatgcgacattcgcgactcattctgtttcctctgggcctgattgttcaggggcagtcggtgcgggattgcgggtgatgaacatcgcatcaccgtagctgaaaaagcggtaaccgttgtccacggcagccttgtaggcggccatggtttccggataaccggcaaatgcggaaaccagcatcaacagcgtggattccggcaaatggaaattggtcaccagggcatcgaccacatgaaacggtcggcccgggaagataaagatatcggtgtcgccactgaacggcttgagcacgccatcgcgtgcagcactttccagcgaacgcacgctggtggtgccgacagcaattacccgaccgccgcgcgctcggcatgccgcgaccgcatcgaccacatcctggccgacttccagccactcggtgtgcatgtggtgatcttcaagcttctcgacgcgcaccggctggaacgtgcctgcgcccacgtgcagcgtgacgaacgccgtctcgacgcccttcgcagcaatcgcttccatcagcgactgatcgaaatgcagccccgccgtcggcgccgccaccgcaccgagtttctcggcgtacacggtctgataacgctcgcgatccgagccttcatccgggcggtctatataaggaggcaacggcatgtgcccgacgcggtcgagcagcggcagcacttcttcagcgaagcccaactcgaacaacgcatcatgacgggcgagcatttctgcctcgccaccgccgtcgataagaatcttcgaacccggcttcggcgacttgctggagcgcacatgggccagcacgcggtgcgtatcgagcacccgctcaacgaggatttccagcttgccgccggacgctttctgcccgaacagccgcgccggaatcacccgggtattgttgaacaccatcaaatcgcccgggcgcaaatgctcgagcaaatcagtgaattgacggtgtgcaagggcgccgctcggcccgtcaagggtcagcaggcgactaccgcgacgctcggccaaagggtggcgggcgatcagcgaatcagggagctcgaaagtaaagtcagcaacgcgcatgatggggttcgtctagcagggccggaaagtctagcggaaatattgaaaattctctatgtacctgattgaccgacggtaatctcatctctatacttcgccgccattgagccctgatggcggaattggtagacgcggcggattcaaaatccgttttcgaaaggagtgggagttcgagtctccctcggggcaccacatagcagtatctgagagtctctaccagtctctcagacccaaagaaaccggccacttggccggtttttttgtgcctgtctatctaccgctgtccatccttatccgttgtatccctgtatccctgcttgtatcctgagaaaagtaccgaactttgggatacaaggatgaagcgcgcagatatcaagcgtcggcctctggcagataccactctcgcggggctggagccggaatcaaaggaataccgggagctggatggaaatggcctctacttcagggtcaaacctgatgggggcaaatcttggcagctccgctataaacgcccggcgggtaattgggcgtggatggggctggggggttacccagaggtaggcggcgcgctagcaagagacaaagctgccgagctacgcaaagtagtgagcagtggcgctgaccccctcgagcaaaagcgatcagcaaaagcggcaatagatgcagctaaaactcgaaccttccgagctgctgctgatgcttggttaaaggcaaaagaagaaaagggtctggctccgtccaccctcaataagattcgtacatacctcgacaaggacattctcccagcgctcggggacaaacctctcgacgaaatcactcggacagattgcgcagatcttcaagcatccatagaagcgagagacgctcataacgttgcggaaaaatgtcgcacctggatcaatcaaatctttggtcgagccatcggattaggcctcaccgagaacgacccgggaagccgacttcgcgatatcgccgctcaggcaccgaaaacgcaacagcatcctcatttgctggaacctgaacttggcgactttctgatcgcgctaaaacacacacccagcagactaacggcccgaaccgcagcatggctctgcatatggacggcatcgagaccgggaatggtccgcttggccgaatggaaagagttcgaccttgataaagccatctggacgacaccggccgccaaaatgaagatgcgcagggatttcgtgtgcccacttcccaagcaggcgttatccgctcttaaagaactccaatgtctaacaggccgcagtcggtggttgtttcccggtgtcggagccaagaacccgacaatcagtgaaaacaccatcaacaaagtcttcgcaacggttggttataaaggtcgtttggtcggccatggaactcgccacactgctagtaccttgctcagggaacacggttggccaaaagaacatgtagaagcgcagctagctcacaaagaagagggcatctctgggatctacaacaaggctcaatatttcgatcacagagtgaaaatgatgcagtggtacgcggattacctagatcagttggctgctgggaatctcactcacgcacctcttgatgaggtggtatgagcacgtacatccgtacctcctccaaaagcggtgttacaggtgttacgcgtgtaacgacctatgcgaaacgcccgaattcattggctttcaagtccgttacacgaatgcgcggcgccccctactcccggtgtaactcgacacaaacgtgtaacgccaaaacgagccctcgccctgctgcgggccgctgcttaccgcgtgctggcagagggctttcgctggttacgctcgccaaatattgggcgtgggatcaagacgcacacgatgcgcgagatactgcgcgatgactaataaccaaatcattgcgcagtcggcactcacgtctggtttgagaggatatctgtcagaccaatcgctatacgctctctgccgcgaacagctcactgacgtgtgttacttgatcgatcagtgctgtcagcgcatccagagcggaggcatcagcagcgatctcagcagcatgtgcatcaaggcgaccatgcatgaggaaaccattttccagtacgcctctaccgaccacagagcgcgcctcgcacactgggttcgtcaatacagcggttgtcacgctgcttcggatcgagaggcacatgcggcctacatcatggcctgcgctgtgaaggcactcggcattttgagcgactggatgcgtgaagccgatcagaaggtctggtcatacgtgtcgaagcatccgaccgactggccttggagcttctactgtaatttcgtcgagactcagattgacccgcgggaacgcattgaggcgctcgagcaatacgcgcttcatctggagccgattacttcacttccctgccttatcgatgatgagctgaccccaaccgcagatagagctatcaaaaacgccattcgcaagaaaggtggcgtcgtcagtgggatagggcgagctcaagacatgaccactcgcgatgcggctatcactaagcaggcccttcattacttggcgagcggcatgtcacacagggatatcacctcgaaggtacattcctggctcgagcaggaagtcgcaaagccacccgcgcagcgccctgagtggatcgcccttgaaaccgaaaaggcgttgtctcgtaaaagtgtcgaggcaattctcaagcgcaacttcgtggtgtaaacctgaaatttcaaatggaagtgaactgctcaccggcgcccaatctctagaccattgctctcgtccaaaccaatcgagagcaataccaatgacaaagaacctcacccaattccccgttccaaccttttcaaatcttgctaatcctttcgactctacttccgccgtaccagatctagccactccgtttgatccctccactaccctcattcgcatgccgcgtcttgagatcgctacgggactcaagcgctcgactctctacaagctgatgcagtgccctgaaagtggttttccacgaccggtaaaactgagcaatagcaacgcacgcggagctcctgtcgcgtgggttctttctgaagtccagagctgggtcaaaagccgcatcgaggcccgggatcaggtggccgcatgaagcgcaattactgccctttcaagggaccattttttgactcgtacagcatcggatttcgcctctatcaacctggtgaaattaactggcgccatcgcactattgcgggcgtgagctggaacggcgaagagcaagaagcgttctttttcagccctgacgatctcgtacttccactcaaagccaatccttgggaactgcccgaactgatccgcaaaaatgcggtgcgcagagagttttcgagcgttcacggctccggctattttgctatgagcgaaagccgcctcgcctcgttgaaatcgcgcggcatgaccgactgggttacctactggctcgtcgatcaatcagcgggattcgcgaacgatccggcggtatggcaacgcatcacggatgaggatcttgccgtcgagaagacgacaagcgagcgcgctcataaagatatgcgcttgacctccgacctgaacggatatgtcgaggagtgtgttgcacaacgccgcgagcaaatggactctgtacaccgtcgccgctgtattgaagacagcaagatcctcgcctggctcaaaggcgaaacaccgcctccactgttcgctaatgcgcaggaggcagcatgaatcgcaagatcgctgataacgccttgatgcatccgttctccgtgctgcgccgcatcggattttctactcgcctcatgcagcgccttgaacgccaccgcagccaacaggaaaagcgaggccgcgtggtcagcatactgagttgggccgacggcacctggtgcgccctctccctccactgcgaaaaaaccggcgcggtgatcgtcgacgaaggccagcaaacccaagcctacgaagacgcccgctcaatgctcagcggcggcttcctaccgctcctatccctgcgctgggaagcccatgcctgaaacgaaaacgcctccgggggcgatccggaggcgttgaggtcaatctacatgcacgaacaatttatgccgcacctgaaaaaaccgcaagccatcagcgcagttgcactttcgaaaaacggacgttactctttggccgtcgctgcaaactcagtgaccgggcttggtaacccgttgaacaataggcgcaacagcgcccatatctcttttgcaggcgctttttttgcgcccgcaaatccgtgttatggcggctgtgcgtgggagaccttcgggtctgccgggttcctattgtcccggtttaccaacctgcgcacagctgccacccattcgcttggtaacgaacgtggcagctcctcaacaataggagcttcgccagatgcacgccctcaatccgtccaaaattcgcgccgctgcacaccgtgcaatggctctcgccgctctacacgccaattccagtctcgctacacgcctctcccgttacaacgctcacatggccaaagcccgcgcactcgaaaccgcaggcggtgcccaatgaacaacgctttgagtttcgccctgcccgaagacctgctctgcgtgaatccgaccgcagaagccggtgtgcccatcgacgccattacctgcgcaattgctcgcgccgactcggtgctgacgttgcttgaagaacactttgaaagcgactcctcgcgccttgctaaccacgttatcgcggccgtcctctgggacgtgcgcggcactcttggtttgattaaaacactgaccttgcacggcgactccacctcgacgcctgctgcgcagaaaggcggtgcgctatgaatacctccaccaccctcgggcatgccaccttcactcgcgtgaacgcctccgacttgaagttgttccgggtcaatgccggagtaccggtcgaggatgcactggagatggtttccctgctgcagcatcacgccaaccaactcaacttcgacgccgccatgagcgacagcggtgagcgtttcagttggcctgctctgtaccttggcgagatggccaaagcgctgattgatgacatcaacgacgcactgtttctgccgagggctgacgcatgagccaacgcccgagcacctccgccaaacgtccaagctttgccgacgttaaagccgccgcactgaaagacattgatcgcgttctgtctcactggctgcccaatggcaagcgcgtcgacggaggcaaggaatacacagcacccaacccgacccgcagcgataagcgcgccggttcgctcaagatcaatctgagcaagggcacatgggccgactttgctaccggtgacaagggcggagacctgattgatctggtgcactatctgaacagcggtacccacgtcgaggcctgcaacaaactcgcagacctattgaatgttccgcccggcaccgcccaggcgaagagcgcgcccgccaagacgaaagcccctgagtggattgccattcagccggttccagcagaggcaatgaacaagtgccctgccaagcatcggcaacacggcgcaccgtccaaggtgtggatctaccgtgacacacaaggcaatccacttatggcgctctaccgcttcgacctctcgtccgatgaggacggcactccgaagaaggtttttgcaccccttacatggtgcgagcgcgccgatggccaaaccaaacaatggcgctggcagggtctgcccgatccacgtccgctgttgcgccttgatgaactggctgaacgcagtagtgcaccggtcgttttgtgcgaaggcgagaaagctgccgacgctgccgccgaactgctgccgagccacgtggccacctgctggccgaacggttccaactcttggcacaaagccgacctgacaccgctgaaagggcgcgatgtattgttgtggcctgacaacgacgacagcggcaaagcctgcatgaacaccgtcgccgagaagctgctcgaaatcggcgccgcctcggtaaggctcatcgcgctggaggtgttcaagcgcaagcccacgctgaagagtggccgcgccgccttcgccaaaggtggtcaatgggatgacggtgatgacgctgccgatgcgctcatcaaaaattggacagccgcccatttcgccgagctgcaaagcagcggcgagctgtatggcttggtcgaggaaaaaccaaccacgaagcagacggaagccaagccggacgcgaagacgaaacccgcagccaagcgcccgacgaaatcgaaaaccgacctgatgcccggcggctttcgactcacgtctgaaggtgtgttttatgccggtgacgacggtgaagcgcgtcccgtgtgctcgccattggagatcctcgcccgtactcgcgacgacaaaggtcagaactggggcttgttggtcgagttcgacgatcccgacggcgctaagaaacgctggaacattccggcgcgcaccatgacgggggacttcggcaaagacgtactcggcccgctggtagacatgggcctgcggcttgcaggaagtcgttcaggacgcaatgcacgcaatgatctgcagagttatctcggcggctttgacagcgcccaacgggcacgactggtgacgcgcctgggttggcatgacaccgcgtttcttctgcccgagcagcaagtcggcgcgcacagcgaacacctgcacttctacgaggccggttcgcaacttccgccgatcagcgaagcgggcacgcttgaacaatggcaggagcagatcggcgcgctgtgcgtcggcaatcatcgtttggcgtttgtcgtcggcgtcgccttcgctgggccgctgctgcacatgcttggccatgagtcaggcggctttcacttgtacggcgacagctccggcggcaagacaacgcacttgcaagttgccgcttcaatctacggcggaccgcgtctggtgcgttcgtggcggtcgaccgataacgcgctcgaatccatcgccgccgcgcattccgacggcgttctgatcttggatgaaatcggcatgtgcgacccgcgcatcattggcgaaacggtgtacatgctcggcaacggcaccggcaaggcacgtgctaacgatcgagggcaagctggccgacaggtacaggagtggcgcctgctgtttctctccaccggcgagaagacgctggcccagcacatggccgaggccaacaaggaactgaaagcgggtatggaagtgcgcatgcttgctgtcccggccgatgccagcaaaggcctcggcatgttcgatgtgcttaacggttttgaagatgctgcggcactgtccgacgcgctcaaagcacgcgtagcgaagtactacggcacgccgctcacagccttccttaccgcgctgtgtgaacccggtaagcgtcacggctgggcagccatcctgcgccgcacactggaaggttttatcgcccagtcgttaccggcgtcggccagtggacaagcgcaccgcgccgccgctcgcttcggtctcgccgcagcagcgggcgagctggccacggcgatgggcatcacaggctggcccgacggcactgccaccacagccgctcgagtgtgcctcaacgcatggatgaacgagcgcggcggcgcaggcaacttcgagggcgatgcgatcttggcgcggctgcgccaggtcatcgagcgcttcggtgaaagccgcttcacgcgctgggaatcggcggcagcaaaaatcgatgagcacgggccgcgcaccatcgaccgactcggttttcgtaagacgttggagcacggtctgggcgatgcccttcacaccaccaatacctactacgtactccccgagttatggcgctcggaaatcttccgaggcatgaacatcaacgcggtgaacaaggaattgctgcagcgaggtgttctggaacccgggaaggacggtaaggcgtcgagcctgatccggttacccggtctcggtacgcaacgctgctacatcgttaagacgattccaggaatggatgagagcgaggctcgggctgcctgagggcatctttgcttatcgaggtagcgccggcttgttcccggcctcgccagccactcaaccaacccacaatcgaattgaacagagaccaaacacatgaacgagattcaagaactgaaagaccgccgtgacgaactgctgagcgaggcagagcgactgcaagccgaaatgttgccacttgagtcggcactggaaagtgaagaactcattgaaccagatcgcaaccgcgaattacgggagaagtacagcgaggtgaaaagtaaatttcactcgcgcaagcacaatgccgacttaataaatcggaagatcattcgccgtgaagacctcgcgaattgcgattcgctgatgtcgggttacgtcgaggcgatgaacaactggaaagcggatgagcaggagctgaacgaaaagcgtcgtagcctcagcacccgccttgagcaaatccaacaacaagcggctgaagacatggccaaggcacgtcaggccgaaacagacgctgccacggcatacgcgcaggcagtcgcctggggtgacaccgaaggcgagaagaccgcgaacgccgacgcacaaaaggccgcgaagaatctgacagccgccaccgaacataaccgtcggcaaaccctgatcatggcagcgttagagcaggagctggtgacagtagataaatacatcaccgaagcacaggaaaagtataaagaaatcgaacgaaccgccctgtggctctcttacacggtgctggaagagaagtggaatgaggccgcaaaagcgttatttgaggtaggcggaaagctgtgggcgaactacaacttactcggcctggatcaagtgaacctgatgaagctgacggttcccgaagaaggtgaacgcttcggcaattggacgtggcgtgaactgtccgaccgtgcccgtaaatacagcgcactcgacttggtgcagctcgacggtctgctaagccctcaacgatccgaagatgtgagcactcaggaacaatgcaaggatgaagataatgaacaagccaatacagaacagcgccagttggtctgacacgctcaaaactcggaaggcccatctcaatgccctgctgaaaaccatcaacgcagggccgggaaaagctagccctatacaaatgctgaccatcagcgcgattaaatcggaaatggcgcacattgacagccaactgaatcgccggaaatagcgctgaacttataacctgcccgttttatcttaataagtacgcacgaccactccgaacaaggaaaagacaatgtccaaactcgcagaataccgtcagctggaaaaacacctagctgagcagctccaggcactggaagcactgaaaggtgatgatggcctgaagaaagaaatcgagttcgaaacaaagcttcgcaagctgctcgatcaatatggcttcagcctaaagcacatcattaacttgcttgacccgcagagcgccaagcgcactcaaatcactactgcgatacctggcacacgtaagcctcgccagctaaagacttacaaaaacccaaacaccggcgaagtcgtagagaccaaaggcgggaatcacaagacattgaaagagtggaaagcaaaacacggcgctgatgtcgtcgaaggatggctgaagaaataaaaccagctttacctgaaaaagggcccagtagggccctttttgctgcaggcctataacccacaaaatcacccgagtgattaacgacgtgcacaggcgtaagtattctcaacaaattgaagccaccttttggccaatagtggccgttcgaaatcaaccccaattctccaaaagcagaaaaatttagttctcccgagctacgattgtatagatcattgatttgtaacgaatccggctgagcgaaaagcatcttaagaccggccttacggttctagaatcgcacaatatggcgagaggccattgcgcttgatgtggtgttctaggtacattcggtgcattgataaacaagagaactaccatgaagtcaatgcgtgatcaattatatggaatcaagagaaagattaaaaaggactctaaggttactatcgttttgccaagcgagtttacttttaaccggagtgagatcaaacacttcgatcacgtactttcatgtttcaactggaatctgaaaaacataccaattgagattgattttcgctcgtgcagtagtgctaactatcaggctgtatcattattggttttgtattgctggaagctcaagcagcaaggctgcactgtgtctttcctgttagacaatgacgcagacccgaatggtagtagagtctggaggatgctaggtgcgcaaggcttgttcgcagtaagtacggatccacaagtaaattttaattcaaatgaacacaaacctctttttgccattagaaactctgacgactttaaagcatcactacagtctttagatgatttcaccctaaacttcggggttgaataccagaagacattgcgatatgtaatatccgagctcttatataacgtccatgagcacggggtgtcagatttccactggcgaggaaaaagatatccaacgccttcattactgcaattcacctggtatgaacgagcaaacgaactgcacttcattgtcggtgacataggagtcggcgtaaagaaccatattagtaaggcttatccgggtatttcaactgacgaggaggctatccggttggcaatccagcctgaaatatcgggaactttcaccactaaagacccatatgcgacgcggaataacgctggcatgggtttgtttatatcttcaaacattttgaaaaaactacgtggtgacatgcacatcatatccggaaatggagctgttcatatatcacctacagatacaactgcaaagaccctagactcgagctggccaggtacatttgtactagtaacagtgcgacttgatcgggggacggagattgctttagatgcgatgatgagtgagtttcgcgaccatgctaaggctgaaatcgccgcgaggactaaagctgcgactatgcagcaattgtatgttggcatgtataattactttggaaagaatgcggaccttaaatcagaagcaatcaggtatcgagacaaatatattattcaggcgctttcagagggtaaatcactcctactagacttcgtggatgtagatgcatcaacccacagctttctcaatgctttgcttgccactcctattaggcgcctgggcttaattgcatacaaaaaaataagaataataaacgcaacgaatgaaatcagggagacgatagactatattcttgatgacaacactagtgatggcaccgctacgaccccggataatgaagagtgaaattcacgtgcaaatattcgacacatgaagttcacttaatcttcgcgacgtcgatgaggcgcatttttttagtcttgcaatgatacagcgagataaccgatgaaagtaaagtggaaggagaacaagaatctcaagccccagttgctgatggatcggatggctgaaattacatcattaatgccagatggaagggtcagcttttcggcatttgaaaagcatcaacttgatgctgttcttctaacaatgctcgaattcgacaaggggttcagttcctcaacaatgaaagaacttttcaactcaggaatcgattactgcgcgaagagaaatgagtttactaaatcagcttttctcgttggtgttaatgaggcagtaatgaggcgcggggctaggccggaaaaattatttgttcttgtcacctcgatttcgacgtccgaggggtttgcgaaaaaaaatataactctccgtaattctaaaatcaggtcatggccgggaggagtacctaaaaaatatcttacacgtgagaagttagagtggcgtcatggagagtcgccaatgcctgaagattattgcccgattactgtgactgtaaaatcaaaagactcgatggacgccgctcatgcggcaatttacgatttggactacctgcgtggaattcacgcattatttgtaaatccaccatctgaattaagttttgggattggccccaagcgtccgataaacaaaattatgcttggcggtatgcacaccctgcacgactcaaaagggcgtctcgccaatgatcacgtctattggtatgaacaaaattacagggtaagacccccaatccgattctcaaacaaacacaaactttctaaaaacattagctatattgaggagcaaattaacgtccattctgatggtttcaccatcaaagacgcgattgttagatatgttagggcgtatgatgaatcagaccgcaacgtgacaatccagaaagcttgggcagcgatagagtcgatagtttgccctcatgaaaacaatgccggctctatcgttcgacgctgctcctttatgttcgctgaccgcccttattacgagcaagtattagagcatcttcgcgaatacagaaatcgcaatgtacactcgggatacgaggttgaagatctcgattttcattgttatcagctccagcaattttttcggcaagctattttgttttatcttaaaaacgccaccgtcttctcaggcctccaagaagcgaacaaatttcttgatctgcctagtacattggtggagcttcaaaagctaaaaatgcatatagaaaaggcaatgcagtatcagcaactcgacaattaaaatagatgttttgctcgctgctggagcctcaagcgtcaatggcgtagcgcttggaaagtttggcaaccagatgggttactatgaaataacactttcctctaacccattcaaaccgatagtggaaggccagtttgctattacaaagcaaacggcttttaacgggaaaactgattgcaccgcacaaaaggttttgcaggttttaatactgtagatatttcgatcaacgggatcagctttgtctgatcccgaacgccccgtcacttttttccaatatttttagctatttagatacgtaaacggatcgattccttctaaccggcaccaatgctgttgtgtaacaataaacgcctccaatggataaacgctgtagccaagacaccgcatgtaaaagtccagtcccttcaagcagggaaatacataaatcccttctctaccctgctctaagaaatgaacctcatatatcagcccgagggttacgagaccctcaatttgcgggcggaatcgggagatggcgatgccatgactttctttgtctgagagaattttctcatgggtagattcagctataggaacaatctcgcttaaatcccctggaaactgtttgagtacgtctacagccgtataaatcagcttattttttggataataaactgactctggatgcaagcctataggcggctccacgctgcagcatcgaggatcgctataaatgtggttgatcaagcgggcttggaaaggtgtcagacgcttcaacgtatccgtataaattattgagtcatccgcggctgcccgcttggaagaagcaactgccagtagcccagcccacatcgactgcatattcgcatcgtctgtccacgatgcatcttctattatctgccgtaacaacaggggatttgcatctccggtgggttcgagtttttgatgctgaattttctcctcagctttactcgctattgcttcaagattttctttgcgaaaagatgcaaccttgtctttaagcagcaaaccgaactccgccgccgcgggcatacaaatagcactaaagaatgctccaatcccatctaatgacttgtcggctattttctcaactgctttagccagtggttttgtaccgagaatatccaggcttttgtcatcagacatataagcacctaaaaatggaagtcttaatgctcacaataggtagggagcgtcgaattgtctacatcgcattctaaatacgttgcacgtagctgatgctaaagcccctgctgatcggctcgtggatcatttacccgaagacgaacggggtagcaccaagaggtggccccggttctgaatcctggttgtaggagcatagagtcgatggtgtcatctttaacatgctccaatatttgcgtagcgcccttatcgcataggcacaagagttcgttagcaaaagtgtctgtcttgtcggaggatgcgtaaattagcgatatgctttctggaagtattgtctcgttgtggtacggccgcttacgggagttgatacaactgtgatttcctaaagcgtggtcgacaaccatagcgactcgtttagagtccttaatacattgtttcaaatttaactgaatagctaagtcccagccgagaggttcatggacagctgtcaaatcgcgatcaacgattaggtaagcgcccagcggcatatagacgatctgctggtgcgccagctctttgagcgacgaagggatgcaatatatcatcgcgacgctgacgcgatatccccgactcaccgctgccagagtgttggtatctactgccaccaagtaatcaaattgggcacacagctcattaaactgattttttgactgggaaaaatcgattgcaggggcagcgtagattaccttgtcgtccttcccgtcacgagcatgggttaggcggcgctgaatgctggctggatcgatctcaggaatatgaatctcgcccgtctcagggtcgaaattcaaggttagtgagtccactacacctgctgtggttccatacacagcctcagtacgaggtttcttcccttggtcctgcttccgcttgcgcttgctttgctttccactcatctgtgcccccttttatctattgatattacgggaaaaattcaaccgaggtaggaaccctgatggctcgggttagaggtcgagctgtgagctgtttcactatcgctactagtatcagcgcaaaggctttcgtagctggagatgctctgtcacaaacatcatatcgctcatccggcgcacttgaccgctatggccgctgttggccgaaagcagttatttgcgactgcctgcagattgctggcgcaactgacggcctgatgcaagatgattaccgacggctaaccattactaacgggcggtcaagcagctggagcgccctgccttcatctgaaactgttacacgacttgactcagttacacgcttgaaaattggtgtctcagatcggtgtaacttgaataaaacacaataaattcaatagcatagagatgcctgttacaccggttacacgagttacaccgcattttgatcagatacgatccccgctccccggtagcaccaatccctccagcgaacttcaggtgcttctcccgcggtctgccgggggcccctgaggatttcgttgaaacacggggtcggaaacccgccggactttgttagcggacaggtgcccagcttagtgaacaggtgaaccgggtgaacacacggtcaccagtgcaattgcacagatgatgagaggtcgccggggaccctgagcgtttctgaacgacacggggcacaaaacccgcgggatcttggtaggggctgacttttttacaatggttgacaggttgactcggttgacggctcagggcgtgcggaatcagcaacacaaaagaccatcgttaccgaagcagtaacgatggtcttttttcaaccaaatgctttcgatttcaatgactgaaatttcagtaagctgggaggcctcccactaacaagaacccgcgggtttccgaccccgtatcctcaggatatcgtcagggtccccagcgcctttttctgtaacccacccgagatctcagatgagtaacctccagaagctaatcgcagatgcccagtccggcttatcttttcaggaaaaaatctctgatgacggttggcaggcaatcgctaagcaatgtggcgcccccgaaatcgaagagatcgaacagcgtattgccaggttacgtgcagagctggaaacggttgaggagtgggacggagatacccaagatgacatacatctcgcgatttccagctttacccgattactgaggtccgcgaaagcacggtatcgttgctgccagcgacagaaccacaaggattcaacatgaataaattcctcgtcggattcacctaccacgagccagaacggtgggccttgtttcaaaaaggcatcattgaagactgcgagtcatccacaggtatttacgtcgcggcctccactgcaggtgaagcaattgcatgggcagagcgtattgctgaggaactcctgcgggcatccaactcagaccctaagcttgactggaagtcgttgggttacgagtgctgggccgtggacgatccgagcgactccgactggagtcattgcctcgccttttttcaatccgtcgaggtcggcgttttcccagattttgtgaatatgggtgcgagcgcgtacggaaagtgggccgaggaccatgggatttttcctacttaatcctgcaagccccggtaacgccttcactcaacagctgatttccccagcagcgcataccttcagttggaatatgtatgaccccagaatggatcggtcgcggcaaaaccgtcgcacagttgatacaagaacttcgctctttcgaggatcagagtctggaggtccgcatttcctttgatgggggcgaatcctcacagcctatttctcttgttacgaagaaaggagaatatgccgtgctcgagaatcaccaggacacgcccacaatcgttcgtcacggaggctaacgaccgggcgcttcagagagcgacaaagtaagcggcgcgatgcaccctgtatgcccacgtgtgtgcctaaccaaaccacggcaggtcgcccccttataaaccgggcctcatagcctccagttcaaacgacgcttggtctatcgaaaggtttgcatggcaccctatggactattcatactaagcccagcaaaagagaccatgtatccctacatgtatcccgaaatagcaaacctctctggaggccttgagtttactggaggactacagtctccctcgggcaccaaaattaagaaaggtcttgcttagcaaggccttttttttcgtctgcaataaagtccctctcctcactcaacgggcacctgctaaccggcgatgagaccggctgcgcgataaacctggcgaagcatggatagctaacagcgaagaattccaaaccctatccacaagatcaaagtctgctggcgatctcttcccacatatagtcgtagttgtatttcagccaacgaaccagcaatttgtcgaacagcctacgaaaccaattacgctgccgcgccgcgagcctttcctctatctcggctctgagccaatcagggtcaaaacctgtccagacggtgggcaaaacggccgcaatgttcgtaaagcacaccggcgctacttctgaataaaaaatctcgtagagcaccgctggatcaacacctttgagctggcgtgcgatgtaatcgtaatcagtggggaaatggttgaacggttcggacagtgcagctctgacgttcgtcagttgtggttcagtcagaaaatgtcccaatgggaaaactcctcaagttcctcatctagcgagtccgccactagtccgcccgctgcccctccgacgagcgatcccaccaagaccaccgcaattgcaccaagaggagctccggagccaaacaacgcaaggccccctgcggcgcgccgtaccgctctccactgcacaagccacggtcaaaatcacaaatctcctaacccaagaaacgcgccctcgcatgtcacggaatcaggcttcggaaccgaatcaaggctcggcttgcgcacctcttccaaacaaccgcgccgctatcgcccgcccccgctccagcccctcctccgtcaaccagaccgacttgttccttttcaccgggttactgatgaaaccctgctcatgcaatcggttcatgatctcgaagtcgaaccctttccaggcattgccgtcgtcggaactgagtgctgccaacagggcaagcacggcgtcttccatcagtttgtcgtcgtattccatggtcgtcactccattcgtattcaacagttaacgtcgagtgtgtgaaggctcaccatgatactcgccgacctccgacggaaatgccgctcaatcccgtgaaggttattgatcggcttcagcgtgcccggcatcgcctttgggctgcacttgttgatctcgctccgtataatcacgcccctctgaaagtagcccagcacatcttgcacctaaaggtggttgcattcaggcatcaactctcacactgacggacgtcgctaaaggccccccatggaaacgtcactggaaacagtcgccctgttctccctcaagctcgcttacgaggaagaaggtctgagcccgattctgcgggacgacatggtcatgggtgactatcagaaggacattttcgaattgttagtgcgccgtggcgatgtcgaggctattcaattcaagatgaacgagtgcctgggcctggcgatgaatgccttgggcggtgtcgagaaaccgctgggacgcgagttgcacaagttgtcagccgacttctgcaaggcgcagtcgctggagcaactggttcagccgctcctcgcgctcaagggttatttgaaagacatcctgtgatgagctgagccgttacagcagatgcttggagatgtacttggaaatctccaccatcgatgtcttcccggtgaattcgaatttcactttccccagcgacgaaaagtagatctccagctctgagtccagatcgaacgttcccgaggtttccacggagtacgcgacgatgtttttgtatggcaaggacgtgaaatccttcttactgccggtaatgccctgaacgttgactgcgatgatgcgtttgttggtaaacaccacgccatcgcgcatggccttgtaggcgtcgatcacttcttcaccttccagcaagagggaggtaacgcgctcggcgtattcattgttttgcttgagtttgaagaagcctttgttgttgaagtcgatcatctgtccatcctctggttgattaaaaaacccggcaaatcacttgcgcactttcaccactcgaatcttgatcggaaacccacccgctcccttcagcgtcttccatcctacgtactggaatatcaagttctcgtcgatggggtcgccccgctctaccattggtccacccagcaccgcgacttccctgtagacggcgcagctgcccgcattggggccgacgaagtagaccacatagggtttgacgtattgcaccgcgcggaaatgccggccgcatttccagtcgaccttaatcatcaacgtcttcagatacgcttcgccatccgtttccgattcctcggcgagttctttgagcttgccgattccgccgacgtcgctaaagcccagagcacgggcgcgcttgtattccggggatttctggtgctcggcctgatccttgtagtattgctcttgaagctcggcgaccaggaccggctcctccttgttgcggatctcgaacgcttgggcaatgacggtttcgcaacgggcatattcgggagaggcaaggcttgccggggcaaggtgatcgcgatggacgtaaagagtgtgattcaagctgtcgacgcggttcatcgcttgcctgctcgtcatggccccgctttggactctgttcactacgtcctgaaaactctgacaatcggcgaggtatcctttccaggcgacctccggggtttcatcccagccggcaagcgccggggtcataacggtggcgaggaggaaagcgctgagcaggcgcgagacagaagaaacggtaggcatgtgtagtccgttacgcagtggaagaaggtggcgcgaagctactattttgctatcttgccgtccactttcgatggaggcgtatcaagcgcttctgttaacgggcgctcgggaataaatcaatggatgctttgttgtgcttgctggtaatgggcggaacctggttgtgggtggtgaagcaacgcggcgagtggaatctgttactcgccaaccttgccggcgccggcagtagcgtggtgactggcattgtcttcacactgatttacggcgggctcattggcacctcgatggcgacgaccaacctggatcgcagcctggtggttttcatggccagcgccggtgtcctcgcgggcgtgtggatgtgggtcgccaatcgccgccaacccgaacatccgattgcacgtcagttgctgggcgcggtgtgtggcttcactgccggcatgatcaccttgatgtttctggcggtgaattatttccccaacacttgatcggacggtgcatctgttttgctatcgtgctgcccatcatcagcgttcacctcgaacatgcgttggtttcaggtttagaaggtttaaggaaaggatcgaatggattttctgcatttagtggtttttgtcgctacctggggtttcatgtggcgctgggtggtgaagaaccgcggcaactggaatctgttcttcggcaacattgtcggcgtggcgggcggtgtgattgtggccatggtggtgctttccatttcgctgtcgttgtttcccgacaagaaatctgccgaaaccgtcgagacaacagcgcagacatcccaacaactcatgccctccgctgaaacacaggtcatcgcgccggcagagccggccgttgcagtggccgaagcggtgtcgccgccggcacctgcgcaagcagcggtcgccacagccgcttctgccgcgccgaatgccacgacacaaaagtctgaaccgccggaatctgcattgcttcctgattaccgtggccggtcgcgaaaaaccttatccgaaaaccttatcgtcaacgatttcaacgagaccgatcgcgccgtcatcaatgccaaacgccaggctgctggtgatggagcagacgctgaccgatcctacatggccgttgtcatgtgcattccggcgttacagcacgctctgcgtttcccctccacagagagtgtgattggcccggccttcaaagctagccgccagaacgaccagatttataaagtcaccgcggttatctcggcagacaacatgttggccgcgacggtcgtctacaactacagctgctccatgcaagcagtcgcgggcgcagatggcgatacccagtggaacctggtggatttgagcctcacgcaaacatctcgctgaacgccgtttgctgcctgcgctatgatcgccgacctgcacttagagtcctgacaccggatgcctgcttccgcgctatcgcctgattcccccgcctcactgcctgcaatactggcgggccctttgctgcggcgactggaaccggcacgcctggtgatgtggctggtcgcaagccgcaagctttcgctgacgctgcgtctgcaagatgtcgccgatataccgctggacgatggcaactgtacgaccatcgcggtgggccagcatgctttcgtgcatttgatcgatgttgcattaactaccccgctaccctgcgacacgcgggtcgattacgacttgctgattgatgagacggcaagcggaattgccgattgggcgccgcacttactttacggcgatgcccgctgcccgaacttcgtcatacgttcgcgaatcgaccaattgctacatggctcctgccgcaaaccccatcacccggcggtggacggtctgctctgcgtcgatcaactgttagcgacggaaaccgacccgcaacaacgccccgccctgctcatgatgagcggcgaccaggtctacgccgacgatgttgccggtccgatgttgcgcgcaattcatgccttgatcgaacgactcggactgttcgatgaacacctcgaaggcgccgtggtcagcgatagcgccaagctctaccaacacccggccagttactaccaccgtgcggatttgttaccggcgctggaaagtaacgagacattgcgcgagcgatttttcggtggtgcgcgtaagccgattttcaccagcagcagcgctgacaatcacttggtgaccttcgccgaagtcatggcaatgtacttgttggtgtggtcgccgacggcttggtcgctgatcaatccgcaagctcctgaactgacgcccgaacgcctcaagcgctacaccctcgaacagactcgcatcgatgccttcaaggctggattggacaaggtcgcccgcgcgctggcgcatctgccgagcctgatgattttcgacgatcacgacatcaccgatgactggaacctgtctgcacaatgggaggaaacggcctatggtcatccgttctccaagcgcatcatcggcaacgcgttgatcgcctatatgttgtgtcagggctggggcaataatcccgatgccttcaaggatgtcttggagaaaaccctggggctaagcgccagcggtgatgaccaatatctcgacagcccggtgcaggatgctctgatcgatgatttgctgcgctttcaacaatggcatttcgtcctgccgagcagcccggcgctcgtggtcatcgacacgcgcacccgacgctggcgcagtgagatggcgctcaagcaaccctcgggcctgctcgattgggaggcgctgagcgaactgcagcaggaactgctcgatcacccgtcagcgatcatcgtttccccggcaccgatcttcggcgtgaagctgatcgaaacggtgcagaaggtgttcagctggtgcggttacccgctgctggtcgacgcggaaaactggatggcccatcgcggcgccgcgcaggtgatcctgaacattttccgccactcgcgcacaccgggtaactacgtggtgctgtccggcgatgtgcattattccttcgtctacgaagtgcttatccgccaccgcaaggccggtccgcgaatctggcagatcaccagcagcggcatcaagaacgagtttccgaaaagcctgctggaatggttcgaccgcctcaaccgctggctctactcgccacgctccccgctgaactggttcaccaaacgccgacgcatgcgcatcgtgccgtacacgccggaacatgctgaggcaggtgaacgcttatggaattcggcggggatcggtcaggtgtttttcaatgaacaggggcagccgcgggagatcattcagcacaattcgaatggcaaggcgaagacacggatgctggcgccggatctggcggattatccggactaaggtctacaccgaacatgtgggagcgagcctgctcgcgaaagcggtcgatcatccagcagagatgtcgaccgatagtccaccttcgcgagcaggctcgctcccacagtgctacttacaagccatcaatgcgcgatcagtgctcgccccacacctctgacaatcatctccacctcccgctcatcaatcgtcaacggtggcagcagccgtatcgtcttgccacgcgtgacgttgatcaacagtccatgatcccgcgcggcgatcagggtcagatcacgcaccggttgtttcagctcgataccgatcatcaagccctgcccgcgaatcgccagcacattgggattgtccgccagctctgcacgcagacgagtcaacagccgctccccctgaatcccggcgttttccagcaggccctgttcttcgatgatgtccagcaccgtgcaaccgacccgacacgccagcggattgccgccgaaggtgctgccatggctcccgggcgtaaacagatctgccgccctgccccgggcgaggcacgcgccgatcggcacgccgttgcccagtccttttgccagggtcatgacgtccgggacaatgccttcatgttgaaacgcgaaccagcgcccggtgcggccgatgccggtctggatttcatcaagcatcaataaccacgcatggcgattgcacagttcgcgtagcgctttcaggtaaccgggcggcgcgagctgcacaccgctttcgccctggattggctcgaccagaatcgcgacgatgcgctcgccgtgcttttgctgcacctgttccagcgcagcgagatcaccgaacggcactttgaggaaatcccccggcaattcgttgaaacccaggcgcaccgccggaccatcactggccgacaaggtgccgagtgtgcggccgtggaacgcgttggccatgaccaccaccagcggctgttcgatgcccttgcgccaaccgtacaaacgcgccagtttcaatgccgtttcattggcctcagcaccggagttattgaagaacgcccgctccatgcccgacagctcggtcagccgtttggccaattgttgctgccagtcgatgctgtacagattcgatgtgtgcagcagcaacccggcctgctcgctgatcgccgaaacgatccgcggatgcgagtggccgacattggtcaccgcgacaccggccaccgcatccagatactcgcggccggcctgatcccacaggcgagtgcccaggcctttggtgaagctcaaggccagtggttggtaggtgttcatcaaggcggcggtcatgaattgaaactccagcaggtcggtgtgctggcagtatggttagccagcgaaactggataaactcggcaaaacttcattcatttaaaagctgagcttgataatggacttgttccagtcgatgagcgtgtacgtcaaagtcgtcgaagccgggagcatgacggcggccgcgttgcagtgcgacatgtcgacgaccatggttggcaatcatctgcgcgcgctggaacaacggctcggtgtgcaactgctgcagcgcaccactcgacgtcagcgactcactgaattcggcagcgtttactaccagcgctgtctggaagtgttggggttggtcgccgattccgaacgtctcgccgagcagaccctcgatcaaccgcggggcatgctgcgcctcaccgcgccgctgacgttcggcgtcgaacggctggcgccggcgctcagtgagttttccctgttgtacccccaggtcaaactcgatgtgatcctgaccaacagccgtcccgatctactggaaagcggcctcgatgtggcgtttcggctgggcaatttcgaccagtccaacctgatcgcccgacccttgatcgactacaccctgaccgtgtgcgcctcgccgcaatacgtcgcccggcgcggcatgccgaaaaccccggaagacttgcaacaacacgactgcctgtcgttcgcctatcccgccggcgacgactggcaatcggtggaaaaacgctggcgcctcggcggccccgacggggaaatcatggtcgacgtcagcgggcctatgctgatcaacagctccgccgggctgcatcaggcggcacgcaccggcatgggcatcgtgatgctgccggatgcgctggtggaacaagacctgcgtgaaggccgactggtgaaggtgatcgccgacttccagccacccagccgaccgatgcatctgctctacgcgccagatcgctatcgcttgccaaaattgcgccggttcgtggagtttgcgatgcagacgtgggggaaatcctgaggctgcgcgctccacccttccatgaaaaatcgctgacaaggacccgaacagcagatgaacaacactcttaacgtacgtgatttgctgcccgccgaaacgcaatcggtgcggcagtttctcggggagcatggctggggccatcgcaccggctcagctgaacacttcgccctgctgatcaagaactctcagcgcaccgccgtcgccgtcgagggtgagcagatcatcggattcgcccgcggaatcagcgatggtttgtccaacggttacctgtcgatggtggtggtcgatgaccagcatcggcgagaggggattggccgcgcactggtcgagcacatcatgggcgacaacccggatatcacgtgggtgctgcgtgccgggcgcgaaggcgcagaggctttttttgccagcctgggttttgagacctcggtgatcgccatggaacggccgcgccggaaataacccactgcgggaaaaaactcgaccggcagaccgttgctccgtgacaacgccgccgcgctcccctaaattagtcggcctgaaaaagcccttgggttttctcatctccactcaagttaaaaagtagtgaaatttcaatgtccgatttcaacaccgctgaatccgtagtcaccgaatcgtccaaagcggaatacgaaaactccatcaatctttcacaacacctgccacaagccaaaatcatcagcgagatggtcctggacgcgttccagtcgacccgcgaaagcgaccagatccgcgagctgcgcgcggcgatccgtcaggctcacgacagcttcgatgacgacaaggcctacgagctgatgggcgaactcaaggcactgaaagacgccgaagccgccgacctcgccgcccttgaagacctcagcagcaagttctcgatcggccgcatcctgtccagcttcaaggacgatccggcgttccaggaaatcgtttacggcctcgcgctgaaagtgctgaaccagacccatcaggcgatcagcaacccgagcggcggcaagagcaaggctgcgaagaagaaagaagtcgaaatcttcaccatcagcaaggacggcatcagtgtgaccctgccactgcgcacgccacgctcgcgcctgaacgttgaccgtgcagcgctggagttcctcggtttcaccttcgtcggtgaaggcgaagaagcggaactggaaagcgaagtcttcgtcgacaacgctggcaccgagcaggcggtaaaccgcaagaacatcatcaccgcgctgcaacagcagactgcgttcgatggctatagcatcgccgcgcagtaatagcgcagccgctgtacgaaaaagccccgcgctgggattcagtgcggggctttttggttttcggctggggattcgtgaggaggcgaaaatcctcgcccctcacccctgccctctcccgagggagagggagccgatcatgagatattcaagagatgcaccgaaatgaaagtgcggtgccgaatccacaatcgcctcggcctctcaggtcgatgtatagcgcaagaaacctcggtcagtcccctctccctccgggagagggttagggtgagggcaagccgtgaagtcaccctcaagccgaaggatgcaacgctacaatcatgtccacctcaatcgccgcattcttcggcaactgataaacaccgactgtggtgcgcgtgtgccggccggcatcgccgagcacatgactgaacacgtccgaggcaccgttggccacttcactcaggtcaacgaagtccggcgtcgacttcacatacaccgtcacccgcaacaacgccttgatcttgtccagtgaacccaccgcatcgacgatcagcgccaggcaacgcattgcactgatgctcgcggcggcttgcgcatccttgagggtcagctccagtccgacgcgacccgggtactgaatcttgccattagtgcgcggcaccataccgctgatgtacagctcatcatgatgacggatcagcggcgcgtaattgccgccggcggtgttctcaccatagatgtcgtagttcagctcttgggccagggcaataaaacgctcgtcgcaggtcatcctctcagtcatttcgcccagccttatgatcagtgcatgaagaaccgcaggttaagaccgatgattgccggagattcgatttgtggcaggtcatcggcatagttggatccaaatctaggtgtttcacgaagtgatagcaaccggccgctaaggcatccttcgccacattttcacggtgagccgccatctctgcgacgccctgcattaactcagcaaacagatcgcgctttttcatccaaacctgtcccattagaaaatagcctctgggatcctaactaatgaaaagttttctgaaggtaggagatctctctataagcagacagtcgtttcccaaagacacgctcaaccttaaatagcacccaacaaaaaaccccgcacatctctcaatgtgcggggtttttcgtccagcctttaaaccttacggcgcgtacgtcagcagcagctctgcgggcaccttgaagtccagggacatcatgacgctcaacgcagtgatggtgaagatcgagaacacgaacagcttgcgtgcccagaccgtgtcatccaccgctttgtagccggtccaggccatgtacaaccagtacatgcccatggccgcagcgacggcgaggtagctcatgccggcgtaaccgctgaaggtcagcatcaaggtcgccacgaggaacgccaggatgtagagcaggatgtgcttcttcgccacttgaatcccgcgcttcactggcaacaccggaatcgatgcggccaggtaatcattgaagcggaagatcgcgatggcgtaggaatgcggcatctgccacagactgaacatcaccagcaacgtcagcgcggccatgtcgaagctgttggtgacggcaacgtaaccgatcactggcggcatggcgcccgacagactgcccaccagcgtgccgtgaaccgacttgcgcttgaggtacaggctgtagaagccgacgtagataacgaagccgatcaccgcgaacaaagcggccaacgggttggccaccttgtacaacaaagcaacgccgagaacaccaaggatggtcgcgtagaccagggccagtttcagggagatcaagccctgcaccagcacccggttcttggtgcgttccatcttcaggtcgatgtcgcggtcgatgcagttgttgaacacgcaaccggaggcaacaaccagggatgtaccgatcatggcagccagaaacaccgccagatcgacatgccctttcgaggccaggaagaacccgcctgccacagaaagcacgttaccgaaaatgatccccggtttggtgatttggataaagtgcttgagcgacatcgggtctacctcacttcgccatcatgtacgtgtggatgctgaacatgatccacagcgacaggccaaccagcagcacgatcacgatcgccgtgaagacgaatgcgatcacgttgttacgctgagcaatggaacggtccaggtgcaggaagtaatacaggtgaacgatcacctggatcactgcgaacagcagaacgattgccagcgtggtggctttcggcaggctcgggtacatcaccagaccgaaaggaatcacggtcaggatcaccgacaggatgaagccaatggcgtacgactttacgctgccgtggccagcatcatggctgtcatgggagtgtgcattagccattacagagtccccatcaggtaaacaacggtgaatacgcagatccacaccacgtccaggaagtgccagaacaggctcaggcagctcagacgggtcttgttggtcgccgtcaggccgtgcttgttgacctggtacatcatgatgcccatccagatcagacccgcagatacgtgcagaccgtgggtaccgactagggtgaagaacgcggacaggaagcccgaacggctaggaccgaagccctcggagatcagcaggtggaactcgttgatctccatggcgataaagcctgcgcccagcaggaaggtcatgaacaaccagcccagaacctgctgcttcttgcctttgaacaacgccagcatggcgaagccgtaggtgatcgaactgaacaacagcagagcggtttcgcccagcacgtatggcagttcgaagatgtcgtggcccgctgggccaccggctacgttgtttaccagtactgcgtacaccgcgaagatcgacgcaaacagaatgcagtcggtcatcaggtagagccagaaaccgtatacggtcatctcgcccgagtcgtggtgatggtcatcgtgcccatggtcaccatgggcgtgtccaacattggtcactaagttcgacatggtttaagcctgttccaacgaggtttcaacacgggtggcaccggccgggattttccctgccgcaaccagacgcttgtgctgctcggcttcgatacgctcgatcgtttcaaccggaaccatatagccctggtcgtcacgtgcagcgtggatcacgaagtagatgatggtgccggccaggctggcgatcgccaaccaccagatgtgccagatcatcgcgaaaccgaagacggtcaacagtgcgcccatcaccacgccagtggctgtgttgttcggcatgtggatcggctcgtacttggccggttgctggtacgcagtaccgttttccttggcttcagtgaacgggtcgatgcagtcagccttaggcagcacggcaaagttgtagaacggaggtggcgacgaggtcgaccattccagggtgtgtgcattccacgggtcaccgtgatcgcaaacgttctctggcttgttacggtcacgcacgctcacatagagctggatcagctggcaggcgatacccacagcgatcatcaccgcaccgaacatggcaacgtacaggtacggtacccactcagggttggtggtggcgttcagacgacgggtcatgcccatgaagcccagtgcatagagcggcatgaacgcgacgaagaagcccgagatccagaaccagaacgctgctttaccccagccttcgtgcagcttgaagccgaacgctttcgggaagtagaacgcgaaaccagcgatgtaaccgaataccgcaccaccgatgatcacgttgtggaagtgcgcgatcacgaacaggctgttgtgcagaacgaagtcagcacccggaatggccagcagtacgccagtcatgccgccgatggcgaaggtcaccatgaagcccagagtccacagaacctggctggtgaagcgcagacggccctggtagatggtgaacagccagttgaatagcttcacacccgtcgggatggaaatcagcatcgtcgccagaccgaagaaggcgttgacgcttgcacccgaacccatggtgaagaagtggtgcagccaaaccatgaagcccagtaccgagatcgcgcccgaggcgtagatcatcgagtggtggccgaacagtttcttgccggtgaaggccgagatcacttccgagaagatgccgaatgccggcaggatcaggatgtaaacctcagggtggccccacgcccagaacaggttgacgtacatcattggattgccaccaagttcattggtgaaaatgtggaaatccatgtaacggtcaagggtcagcagtgccagggtagcggtcaggatcgggaacgaagccacgatcagaacgtttgcccaggtgcaggtccaggtgaagatcggcatgtccatcagtttcatgccaggggtacgcattttcagtacggtcgcgaggaagttaacccccgtcagcgtcgtacctaacccggatagctgtagcgcccagatgtagtagtccatgcccacgccagggctgtattgcagacccgacaatggtggataggcaacccaaccggtcttggcgaattcgccgacgcccagggacaggttgatcagtactacgccggataccagcagccagaagctcagggagttcaggaacgggaacgcaacgtcacgcgcgccgatctgcagcggcactgcaaggttcatcaggccggtgaagaatggcatcgccatgaagatgatcattatcacaccgtgagcggtgaagatctggtcatagtgttcaggtggcaggtagccaggcgaaccctcggtggccatggccaattgggtacgcatcatgatggcgtcggcaaaaccgcgcagcagcatgaccatggcaacgatgatgtacatcacgccgattttcttgtggtcgaccgaggtcaaccactcggtccacaagtacgtccacttcttgaagtaggtgattgcagcgaacagcgccagaccaccgagggcgatcatggcgatggtcaccatcacgatcggctcgtggaatgggactgcttcccaacttaatttaccaaacatcgtttactcctctgccccggcagctgaatgcgaactcgagtcaatttccgtggccgccacttctttctctttcttctcgtgcttcagcggcttgcccggcttcataccttcgtacttgtcgacgatgatctggaactggttcggcgtgaccgaggagtagagctcgactgggttgttctggctcggtttggcaagggccgcgtattcagcttgatcaagctgtttaggtgacttcttgacttcacttacccaggcgtcgaaatcttcctgagtggtggagatagctttgaacttcatgccggtgaaacccgcgccgctgtagttggcggagataccgtccatttcagcgttacggtcagcgatcaggtgcagcttggtctgcatgcccgccatcgcgtagatctggccgcccagacccgggatgaagaacgagttcatcacagcgtcagaggtgatcttgaagttgattggcgtgtgcgccgggaacacgatcttgttgaccgtggcaatgccttgttccgggtagatgaacagccacttccagtccagcgcgaccacttcgatggtcacaggcttgacgtcggattgaatcggacgatacgggtccagttcgtgggtcgaaatgtaggtgatgtaacccagggcaatgatgatcaggaccgggatggtccagactgccacttcgatcttggtcgagtgcgaccatttcggggtgtagacggcgttcttgttcgacgcgcggtacttccaggcgaacaggaaggtcatgacgataaccggcacaacaaccaacagcatcagcagcgtggcggtgatgatcaggttgcgctgttccaggccgacctggcccgttggattgagcaaggtcatgttgcagcctcccagcaacaacgtgccgagcagcggcactaggcctagtaatctggggtacctgtttttactcatctcacgacctctaaagcagcttgcgcaatgcagttgggttttgatcgccaacacttcaccctgccaagggttggcattttctttggattgaataagggccgcccgtcgcgcgtcagacgctcgacaaaacctgggacagcggtcagttcttattcgaattcgtggtcaaaggccttgttacagaccaattccatttggtgcggaaagttggaaggcaccgacacctgggtgtcttggaagcctttcgactcactcgacacccgactttctgcgcagcgccttaagaaaaagcgttccttaataaaggctgaacagtgccgggaattcagtgcgggcgattgtagataggtagcgccctatacaccatgtcttatcccgaaataatttttatccgttcgagcaacaatccatcgccatttttgcaaaagttccgcatgttatcgaaatcgattctcaacaaaaacaccaaaaattgtaggtgtacccgccccagttcagacagctctgagggctttttccgacgcctcgaacagcgcaagccccgataacccaaggcttttggccatatgccagcgcttgttaaaactgcctgctctggcactctcgtgctaaagccgaaaaacctcgaaacagaccaatccttttttgtaacaacgaccgattccgtgtcactgaagagcgctgcgacacggcgtgtgtgacaacatgtcgcacatctgccacaccctcacttgccgtccgtcacggtgttttcacaaacactctgaaatgcaaaacgccccgatatgctgatacgcaaatcgaggcgttttctgtatcggccagactgccgattagttgattcagcgcagtgcttttcggttacgcaaggtcagcagcggcaccagaatcaccaccagcacgaacgccagcaacgcccattgcgccaacgacagaccgagaatcggcggatacggtgtcgagcagaaaccgtcgacctgaaagcccagcgggaagatcttcgccagcggcaagtcgtcgacaattggctgcagcacatcgatgccacaactcactgccggatagaactgggtgtacacgtgatggccggccacagcggcgccggcaatcgcgcaaatcactaccaggacttcgaacacggtgatgttgcggcgggtgcgcatggccgcgccgataaaggcgaacaatgcgatcagcagcaatgcataacgctgcaggatgcacagcgggcatggcgcctcgcccagtacgatttgcatataaagcgcgccaccgatcagcgccagacagatgatccccaacagcaccagaaagcgccgctcacggcccaaccgaatcgtttcctcgctcatcgcgtttcccttttatgtccatggttcagccggccgacggctgaaagttgtcgcaagtctacaccgggggaataaacgataaagcagttaaggaaccattaagttgtagggatattttgcgaatcagaatggtgtaacggccatcgcgagcaggctcactcctacaatggatctgtgtcgtacaccattctcatgtacgccactgcgcctgtaggagtgagcctgctcgcgatgaaggcgactcggtcttaaggattactccagagccgcagccggcccaaagaactcgtaacggctctgcttctccggcacacccaaggctttcagatgacgcttgatcgcccccatgaaccctttcgggccaaggaaatacgcgtcgacatcacgctgctccggcagccattcgcccaactgctccagactcagcaggcccaccttgtccgccgccgggctgacgccatcgtcttcggcgtagcagtagaaacgcttgagttgcggatgacgcgccgccagaccatcgacccaatcgcggaacgcatggacgctgccattgcgcgcgcagtgaatgaagtgcaccgggcgctcggtttccagcgccgcttcgagcatcgccagcgtcggggtgatgccgacgccgccgctgatcaacaccagcggtttgtcgctggccgtcaaagtaaactcgcccgacggtggaaatagctgaatgctcgcgccgacatgcagttgatcgtgcaaatggttcgatgcgcgaccacccggttcacgcttgacgctgatgcggtactgacctttattggccagcgccgacagcgagtagttacggcggatttcttcgccatcgaggatcagcttcatgccgatgtactgacccggttcggctgccagaatcgggcccttgtcgacaggttcaaagtagaaggagatgatttccgcgctctcctcgaccttggccgcgacgatgaattcgcgcgctccgcgccagccgccaaccgcttgttctttctggtcgtagatcgcgccctcggcaccgatcaggatgtcggccagttggccatacgccgcgccccaggcgctcatcacttccggggtggcgatctcttcgccgagcacttcggaaatggcgcgcagcaggcaggcaccgacaatcgggtagtgctccgggaggatctgcagagcgacgtgcttgttgatgattttcgctaccagatcgcccaactggtcgagttgatcgatgtgccgcgcatacatcaatacgccgttagccagggcacggggctggtcgccgctggcctggtgcgcctggttgaacagcgggcgaacttccgggtattcagagagcatcatgcggtagaagtgcgtgatcagcgcttcaccgccgctttccagcagaggcacggtggatttgacgatggcacgatcctggacgctaagcataaggtgactcctgagcttcttgaaaaagttacctaagagtcatcagtattcgtgccaacttatttatcgatataaatcaataagttgagatttaagtagtcataaagactcagagcaccttatagtcatctcgactacatcgtgtccctttgactacaagaccatgaccgccaaatccctgctcaccgccctgctgcctctggtttccgacctctcccgcgaactgcctgagggcgagcgttaccgacgcctgctcgaagccatgcgcgcgctgttgccctgcgatgccgccgcgttgttgcggctcgacggtgaatcgctggtgccgctggcggtggacggcttgagtaccgacactttgggccggcgcttcaaagtcagcgaacacccgcgcttcgaaatcctcctggccggcgccgggccgacccgcttcgccgctgacagtgatttgcccgatccttacgacggcctggtcgatggtctcgatgatcatctagaagttcacgactgtctgggctgccctttgtttgtcgaagaaaagctctggggcctgatcacccttgatgcactcgatccagagcgtttcgaacccatcgaactcgacgccctgcaagcctttgccagcctcgcctcggccacggtcaacgccgccgagcgcatccaacggctggccactcgcgccgaagacgagcatcaacgcgctgaggtttaccgtcaggccagcggtcagcagaaccgcgaaatgatcggccagagcaaagcacttaaacgcttggtggaagaaatcgatctggtcggtggcagtgatctgaccgtgctgatcaccggtgaaaccggggtcggcaaggagttggtggcgcaggcgatccacgccgcctcaccgcgcgccgaccaaccgatcatcagcctcaactgcgccgccctgccggacaccctggtggaaagcgaactgttcggccacgtgcgcggcgcgttcactggcgctaccagcgaccgtcgcggcaagttcgaactggccaatggcggcacgctgtttctcgatgaagtcggcgaattgtcgttgacggtgcaggccaagttgctgcgggttttgcagagcggacagttgcagcgcctgggctcggacaaggagcatcaagtcgatgtgcgcctgattgccgcgaccaaccgcgacctggccgaagaagtgcgcagcggccgctatcgtgccgacttctatcatcgcctcagcgtctacccgctgcgcgtgccggcgctgcgtgatcgtgggcgtgatgtgttgctgctcagtggtttctttctggagcagaaccgctcgcgcatgggccttaatagtctgcgcctgaacagcgacgcccaggaagcactgctcgcctacacttggccgggcaatgtgcgcgagcttgagcacttgatcggccgcagtgcgttgaaggcgctgggcaattgcaaggtgcgaccgaagatcctcagtttgagtgcggcggatctggatttgccgcgtgaggttgtggataactcagttgaggctgttgtcggtgccgtggctgagatgccgctgatcagtggggatttgcgcagtgcgaccgagcagtatcagcggcgtttgatcagtgcggcgctggagcggaatcaggataactgggcgagtgcggcgcgggagttggggctggatcgggcgaaccttgggcggatggccaagcggttgggcatgaagagctagaagcacaccctcaccctagccctctcccactgggagaggggactgattgggggatattggagatgtccgccgacgtgaacctgctttaccgaatccataatcgactcggtcgttcaggtcgatgtacaacgtttgacacctccgtcggccccctctccctccgggagagggctggggtgaggggcttggctttggctttggcttttgatctgcacgccacccgacaactaacctaaagcccacccctttaacgccgataacccggcatcaatagtttctggcgatttccaccctcgcccaccacctttccacagaaggttcatatgtcctccaccaaagcccgcgcagactcactttcgcttctgctgtttaccttgcgcagcggcaagttgatggcgatcaacctgctgaaagtcagtgaaatcatcccctgcccgccgctgaccaagctgccggagtcgcacccgcacgtcaaaggcatcgccacgttgcgcggtgcctcgttgtcagtcatcgacctcagccgcgccatcggtgaacgtccgctggaagacccgaacggcggttgcctgatcgtcaccgacgtcagccgctccaaacagggcctgcacgtccaggctgtgagcaaaatcgtccattgcctgaccaccgacatcaagccaccaccgtttggctcgggcggttcgcgcgcctacatcaccggtgtgacctcggtggacggcacgctggtgcaggtgctggatatcgaaaaggttatccacagcattgccccggcgcagatcgaaatggccccgaccgacctgaccatggaagacgccgaagtgctcggcaacgcgcgcattctggtggtcgacgacagtcaggtagcactgcagcaatcggtgcacaccctgcgcaacctcggcctgcaatgccacaccgcccgcagcgccaaggaagccatcgactgcctgctcgacctgcaaggcaccgcgcagcagatcaacctgatcgtctccgacatcgaaatgtccgagatggacggctacgccttcactcgcaccctgcgcgaaacgccggacttcgcccatttgtacgtgctgctgcacacctcgctcgacagcgcgatgaacagcgagaaagcgcgcctggccggagcgaatggcgtgctgaccaagttctcctcgccggaactgacccattgcctgatcgaagcggccaaacacgtcgcggcacacgggcactgactcttggccgagacgtattgttttttgatgcggcgcgacctcggtaaggacgcgccggatgcaccttggccacaagatattgaactgtgtacgtactccgtcgaaatggcggcggacgtgcatcatttgatgcaactcggttatcacgaaggcggcggccgagtcccagcgctggacgcctggcagcagcagttcgaaaccgatcctgaatacgatccgaaactgtgcttcattgcccgcgatggcgaagctgtcgtcggcgtggcgcaatgctggaccagtgcctatatcaagaatctggtggtgcatccgcggatgcaggggcgcggattgggccgggcgttgctgttcaatgcattcaaggtgtttcagcaacggcgcgaagggtttgttgatttgaaggtactggaagacaaccggcgggcgcagcgcttgtatgaaagtgccgggatgtatgtggtccgccgcgagctggtgccggactgattaaagtcaaaagatcgcagccttcgtcagctcctacagggaaccgcatgttcatgtaggagctgccgaaggctgcgatcttttagcggtgtcccaggcaacaaaactctttaggcagactcaaaccttggccacccacgaccaaggatgccccccatgaaaaccctcaccgccagcctgctctgcctcaccgccctcgcctcccaggccaacgcctccagccccgacgcctgggcggcctacgacaaaaccgtactcgccagttgcaccaaagccagtggtctgaaaaacccaaaaccggtcggcactcccgcgcaattcgatgatcgcgtgggctacaccgccgttctgctgcaaggccaatacccgcaaaaacacatgaagggccagcaaggcaccgaactgtgtctgtacgacaaacaatcgaaaaccgccttcgtcaccgagtgggactcgatccgtccgaccgccaaagcgaagtgagtggcgcacaacttgcttcaacccgggcctgtgcggtggttttccgtcaccgtttcacaccttgattgaagacagatcgctcaatgaatacgacgttttcctgcgtaggctgcggcaaatgctgcaccgatcaccatgtccctctgaccctggccgaagcccgaatgtgggcggcggatggcggtcaggtgatcgtgctggtcgaagcctttctcggcaatggtctgggcttgccggcgcaacagcgtgagcacgctgaacgtcgctccatagtcgttcgcagtggcgcgacagacgcccatgtggcgatcaccttcgccgcgtacaacgtcggcccctgtcggaatcttgacgaagacaagctgtgccggatctacgagcggcggccgctggtatgtcgcatttatccggcggaaatcaacccgcacatcccgctcaaccctgctgccaaggattgcccgccggagtcctggcaacaggggccggtgttgattgccggtggggaactggtcgatcaggagctggttgaattgattcaacgttcgcgccaggccgatcgggatgacatcggcaccaaggatgctatctgtgggctgctggggattcgtaccacggcgctgaagggggacggctttaccgcttacctgccgaacatgacggcgttcgccacggtcatcgatcaggtgagtgcgcagccgccgggcgacgcatacagtgaatggctgtttcatgtgtccggagatgacattgccgggcaagtgctggcggcaggggcgcaagtggtgaccgagccggcgcagacatacgcgtttatctcgttgcgggcggcctgatcagaattttacgccgaacgaactggcctcatcgctggcaagccagctcccacagggttttgtggcgtacacaaattgtgtgaacacccgagaataatgtgggagctggcttgccagcgatggggcctttgcaggcaacctcaatcgcgaacctgccgccgcgcccagaactcccgcgccagcaaccttaaatccccggccaacctcgccacatcctcggagttgcgctgactctgccgcccctcatacagcgccacatcgacgttgcgaccggtcaccgggagattgatcttcatgggatagcgcgctcgttttattggaaaaagtcggcagggctgctgactctaagcgcaccaaatggctaaacgttgatctggcccaggaactgggcacttagccatcactgtgatgaaaaatcacagcgatggccgcagacgggattaaaactcagcgcttgcccatcgaacgacgggtgcccggcggcgccatgcccggggtcttggtgtggccgttcttggcgccgttcttgtaccacggctggttcgagcctttggcagaggccagttcgcccggcttgaacggaaatttgaacgccgggatttcggctttggtatcgctggtttcggccagttcagccgggacatcgctcacagcgtcgtcaaccggcggcagggtcggggaagtcataaaagctccggaaagcaaaaagtcgggcccgatcagtgagccgcgaaggcgcgcagtatacctgtgcgccaaggttgggcacctgaagatttgcagcgcacgccgaacggtttacaggtaactgatgatgacgatgcctttgtcggtcgaggtcttcagcgcttcgtaacgcatggaaatcggcagcgcctgatgactgcaagcgttgcgatcggtgtcgacatcgactttcacgccgggcttgatttcgatctggcgagactcacgagacgcaaacgccccgaccggtccgacctgacagcccgagtcaacgatctgcccggtgaagcggatctcgccggattgactggcaggcgctgcaaacgtagtgagtggaagcaagaggagcacagacggcagagcggttttcagcttcatttcaagacactcccggggtgatgcccagagaaggcctgggctacacattatttatccgcgtgcaggggcggatcttgagaagcgtagttggcaaatgggtcccgaatagggactgatcggtcctttttgggaccgttataccgccatcgcgagcaggctcactcctacaattggaatgcgttttaactgtgggagccagcctgctggcgatgaacgatgacgcggttttcaaccctgcggatctacccgatccagcgcccggtttaccgccagctcggcgagcatggcgtcttcgagtggggtggtgggatcgatgggtggatctggaaccggcttagtcattggaaaccctattttgcaaatggaagccatcccttgccgtttctcacgcggcgaagtgggtggcagctatgtgcgggatgagaaaccggaaaaataggaaaccggccataccgaagtctgcccgcacatagccaccatgaagcatttgcaggcagcggacaagccgccggcaattatgcggactgatggactgaatcactaatttttcagggttctcacacccgatcgccgagctttcggcgacaaccaaagactagagagcgcacgtccgacggacaacctgaaaaccttgtgggaaggttctggttatttgacacagatttaaacagtcaaaagccaaccctcaccctagccctctcccgaagggagaggggactgaccggggtgtttgggagagctacgccgacgtgcgataccgcgctgaactcagattctgaaaagctcacaaatcggctccctctccctcgggagagggctggggtgaggggcagccccaccacagaatcaaagcccagcacgctgtgctcctcaccactcaacaggatgagcgttagctcggctgcagctcttgatctgtaaggcgacgtcggaaggctgagtggaggggttgatccgggggtgggagcgcagcgaccgtttggcgcagccaaacacagcgagaggaggtgcagcgaagcaaaccgtaggcgctgcgcccggatcgatcccggagcgaaggaaccccgagccccagcgagcgggccgcacgtaggagcaagccttttgggttaccttttcggcgtttggaaaaggtgacccgccgtaagggcggaaccctaagccgccgttaccgcagcaacggatatgcacccaacgaaactgacagcgctgacagctagccgtcaccctactgacccgcagacaggtttataaagacaacaaccctgcccaaactccgtccggcgcccaccccgcatgcgaatccaaaagaacaaagccctgctcgccactctattgatcgtcctcgcaggcgcaggtctgtggtacgccctgaaacccgccccgaccaaactcgccacccccacagcaatccccgtgcgagtcatcgcggtcagcgaaaaagacgtcccccgctacaccagcggcatcggctccgtactctcactacacagcgtcgtggtgcgcccacaaatagacggcatcctcaccaaaatcctcgtcaaagaaggccaactcgtcaaagccggcgacctgctggccaccatcgacgaccgctccatccgcgccagcctcgaccaggcccgcgcccaactgggcgaaagccaggcgcaactgcaagtcgccctggtcaacctcaaacgctacaaactgctcaccgtcgacgacggcatctcgaaacagacctacgaccagcaacaagccctggtcaaccaactcaaagccaccgcccaaggcaaccaggcctccatcgattccgcacaagtacaactttcctacacgcaaatccgctccccggtcaccggccgcgtcggtattcgtacagtcgacgaaggcaacttcctgcgcatgaccgacaccgccggcctgttcaccgtcacccagatcgacccgattgccgtcgagttctcgctgccccagcaaatgctgccgaccctgcaaggcctgatcagcgacccgcaacgcgcaccggtcaaggcctacatcggcgctgataccgacggcgaaaccggcaacctgctcggcgaaggtcacctgaccctgatcgacaaccagatcaacgccaacaccggcaccatccgcgccaaggccgaattcgccaacgccagtcaaaagctctggcccggcctgctggtcacggtaaaaattcagacagccctcgacaaagatgcgttggtcgtcccgcccaccgtcgtacaacgtggcctcgaccaacacttcgtttaccgcgtgaatggcgacaaggtcgaagccgtacaagtgcagatggtttaccaaggcagcggtcaggacatcatcaaaggcgtgaaggccggcgatgtgctggtcaccgacggccagtcacggctcaaacccggttcgaccgtgcaagtcatgaccgagccgccgcaggtggtgcaagcggagccgaaaccatgaaggcgcacaacggcgtctccacgtggtgcatcgatcacccggtcgcgacgattctgctgaccatcgcgctggtgctggtcggcgcgattgccttcccgcgcctgccaatcgccccactgccggaagcggaatttccgacgattcaggtttccgcgcagttgcccggcgccagccccgacaccatggcctcgtccgtggccacgccgctggaggtgcaattcagcgctatccccggcatgacccagatgacctccagcagtgccttgggctccagccttttgaccctgcaattcaccctcgataaaagcatcgacactgccgcgcaggaagtccaggcggcgatcaacaccgccgccggcaaactgcccaaggacatgccgacgctgccaacgtggaagaaggtcaacccggccgacagtccggtgctgatcctcagcgtcagttcgacgcaaatgcccggcaccgaactcagcgacctggtggaaaccctgctctcgcgtcagatcagtcagatcgacggcgtgggacaaatcaacatcaccggtcagcaacgtccggcgattcgcgtacaagcttcggcggacaaactcgcggcgatcggcctgaccctcgccgacatccgactggcgattcagcagaccagcctcaacctcgccaaaggggcgctgtacggcgaatcaagcatctcgacactgtcgaccaacgaccagttgttccaccccgaggactacagccagctcatcgtttcctacaaggacggcgccccggttcacctgcgcgatgtcgccaaagtggtcaacggttcggaagatgcctacgtgcaagcgtgggccggtgatcgcccgggggtgaacctggtgatctcgcgccagcccggcgccaacatcgttgaaaccgttgatcgcattcaagctgccctgcccggcctcgaagcgatgctgccggcctcggtgcaggtgaaaaccctgatcgaccgcacgcagaccattcgtgcctcgctgcacgaagtcgaaatcaccctgttgatcgcgatcctgctggtggtcgcggtgatggcgctgttcctgcgtcaattgtcggcaaccctgattgtttcagccgtactcggggtgtcgctgatcgccagtttcgccctgatgtacatcctcggtttcagcctgaacaacctgacactggtggcgatcgtcgtcgcggttggcttcgtcgttgacgacgcgattgtggtggtggagaacatccaccggcatctggaggccggcgacgatatgcgcgaagcggcgatcaagggcgccggcgagatcggcttcaccgtggtctcgatcagtttctcgctggtggcggcgtttattccgctgctgttcatgggcggtgtggtcgggcggctgttcaaggaatttgccctgaccgcgacctcgaccatcatgatttccgtggtggtgtcgctgaccttggcgccgacgctggcagcgctgttcatgcgcaaaccggtgcatcacgcccacgccaaaccgggcttcagcgaacgtctgctcggctggtacgagaaaggtctgcgccacgccctcgtccatcagaaattgatgatcggcgtgttcggtttatcgctggcactggccatcggcggttacatctttatcccgaaaggtttcttcccggtgcaggacaccggtttcgtcctcggcaccaccgaagccgcggcggatatttcctacggcgacatggtgaaaaaacacttggccatggccgaaatcgtcgccgctgatccggcggttcaggcgttttcccattcagtcggtgtctccggcagcaaccagaccatcgccaacggccgcttctggatcgccctgaaaaaacgcggcgaccgcgacgtcagcgccagccagttcatcgaccgcatccgtccgcaactgatgaaagtccccggcatcgtcctctacctgcgcgcaggccaggacatcaacctcagctctggcccgagccgcgcgcagtaccaatacgtgctgaagagcaacgacggcgcgaccctcgcgacatggacgcaacgcctcacggaaaaactgcgcagcaacccggcgttccgcgacatttccaacgatctgcaactgggcggcagcatcacccacatcagtatcgatcgtagcgccgccgcacgtttcggcctgaccgccagcgatgtcgacgaggcgctgtacgacgcctttggccaacgccagatcaatgaattccagactcaggtcaatcagtacaatgtgattctggagctggacaccaagcagcgcggcaaggccgaaagcctcaactatttctacctgcgctcaccgctgagtggcgagatggtgccgctgtcggcgctggctaaattcgacgcgccgaccattggcccgttgtcgattgcccacgatgggatgttcccggcggccaacctgtcattcaacctggcgcccggcgtggcgttgggtgatgcggtgattctgctcaatcaggccaaggccgagatcggcatgcccaccgccatcagcggcaattttcagggcgcggcgcaggcgttccagagttcgctggccagtcagccgtggctgattctcgcggcgctggtggcggtgtacatcattctcggtgtgctttatgaaagcttcgtgcacccgctgacgatcatctcgacgctgccggcggcaggcttgggcgcagtgatcatgctgtggatctgcggtcaggacttttcgatcatggccttgatcgggctggtgttgctgatcggtatcgtcaagaagaacggcatcctgatgatcgacttcgctctggaggcgcagcgccatcgaggcctgtcgccgcaggaggcgattttcgaagcgtgcatcacgcggttccggccgatcatcatgaccaccctcgccgccctgcttggcgcgctgccgctaatgctcggttacggcaccggcgccgaattgcgccagccgctggggatcgcggtggtcggcggtttgctggtcagccagatgctgacgttgtttaccacgccggtcatatacttatggcttgagcggctgttccatcggcctaagcccgcgccattaccagcgctagcaaccacagactgaggcgggtcatgcgcgttctgattatcgaagacgaggaaaaaaccgcggactatctgcaccgcggtctgacggaacagggttacaccgtggatctggcccgcgacggcgtcgagggtctgcatctggcgctggaaagcgactacgcggtgatcgtcctcgacgtcatgctgccgggcctcgatggcttcggcgtactgcgcgcattgcgtgcgcgcaagcaaaccccggtgatcatgctcaccgcccgcgagcgtgtcgaagaccgcatcaaaggcctgcgcgacggtgccgacgattacctcggcaaaccgttttcctttcttgaactggtcgcgcgcctgcaagcgctgacccgacgcagtggcggccatgaaccggtgcaggtgagcatcgccgacctgtggatagatttgatcagccgcaaggccacccgcgccggaacccgactggatctgacggccaaggagttctccctgctcagcgttctcgcccgtcggcaaggtgaaatcctttcgaaaaccgcgattgccgagatggtctgggacatcaatttcgacagtgacgcgaatgtcgtcgaagtggcgatcaaacgcctgcgcgccaagctcgacgggccgttcgacgagaaactgctgcacaccattcgcggcatgggttatgtgctggagagccgtggtgtccagtaattcgattgccttgcgcctcagtggaatgttcacgctggtggcgctgctggtgtttctgttgatcggcggcgcgttgtatcaacaggtcgacaaaggcttgggattgctcccggaagccgagctggatgcgcgttacagcgtgctcgaatccaccgttggccgcttcggtacgcccgagcactgggtgaagatcaacaacaaactcaagctgctcggtgaagaagacaagcgcatcagtttctggatcagcagcggcgatccgcaatacgaatacggcaaccttacgccgcagatccgcgagatcaccaatgggccgctgggcatgcgcgatctgcaattgccggggcagccttatccactgaaagtgctggtgagtgaatttccggccaaagatcagcgcccaccgctgcgcttcatgatcggtatcgataccgagacgtttcatgagacgcagcacaacctgttgatcgcattgatcgccctggcgattgtcggtgtgttgatggcctcggcgctgggttattgggtggcgcggatcggcctcaagccgttgatcaagctgtcccatgaagctcaacgactggcgccaccccttcgcgccgggcgcttgcgtctgtcgccgctaccaccggagcttgagcaatttgtcgactcgttcaactcgacgctggagcgggttgagcaggcctactcgcggctggaatcgttcaacgccgatgtcgcccacgagctgcgttcgccgctgaccaatctgatcggccagacccaagtggcgctgacccgtgggcgctctgccgaacactatttcgaagtgctgcaatccaatcttgaagagctggagcggctgcgttcgatcatcaatgacatgttgtttctggccagtgccgatcagggcaacaaggcgaccaaactcacgtccacttcgctggcggatgaagtggcaacgacgctggaatatctggatttcatccttgaagacgcacaggttgaagtgcaagtcagcggtgatgcgctggtgcagatcgaggtcgcgcatttgcgccgggcgctgatcaatttgctgagcaatgcagtgcagcacaccgggccgggacaggtgatcgaggtgcttattgaggttgaagagcatcaggtgagtattggtgtggccaaccccggaacgccgattgccagcgagcatttgccacggttgttcgagcgcttttatcgggtggatgcgtcgcgtagcaacagtggcaataaccatgggttggggctggcgatcgtcaaggcgattgcgctgatgcatggcggggatgtgtttgtgcgcagtgatcgggggatgaatactttcgggatttatttgccggtctgaaaagcccctcaccctaaccctctcccagagggagaggggactgattgggggatgctgcagatgtgcaccgacctgatcttgattcaccgaatccataatcgactggatctttcaggtcgatgtacaacgccagacacctcggtcagctccctctccctccgggagagggctggggtgaggggcttttgactggcattgaaatatccagtcgaactcaggctttgaagagcatggagatctgctcccttccccctcgcccccttgggggagagggctggggtgagggggtgatttttgctcttgctgtaacagtcatttatgaaaatcacgctgtttcccaacgcccggcaaccttatctttgcccgcaccaaacagcactcgccaagcgagaaggttttcaagatgtccaacagtatgggtattgccagcgcgttcgttttgtcctcattgatcctgtcgccgatggcgatggctgaagaatcgcagtcgttcgtagcgcacaacgtcgctcgcgctcaggcttacgatcagtatcaggctgaagtgatggccaaggcgcaaaatgcctcgcaagccccgcaggctgccacttcccagattcaagcgtccgagaaagacagctgagtcgcgcatcgcgccaacgtttccctcgacgcggttgtttggctcttcccgttcaaccgtcgtcattccaggccgctgcctttcagcggccttttttcgttgtggtctgaaagccgtttggttcgtctgtaacaacaagaaacatcgagcgcctcaaaatatagaggcgccagttgacccaaggagctccattgcacgtgcgttacccagtcagtttcaccccgctgttcattgcaattgccgcaacgattgtgcccgtcgctcaggctgatgagcctgccaaacaaggcttcgtcgaaggttcgagcctcaacctaaacgcccgcaactactacatgaatcgcaaccgcctgcagaaagcggacgacaacatcgagtggggccagggctttctcgggatttttcaatcgggttacaccgaaggcacggttggtttcggcattgacgcccacgccatgctcgggctgaaactcgacggtggtggcggcacggacggctcgagcatcctgccggtcagcgacggtaacggcaaagcgccgggcacgttctccacggcgggcggcacactgaaaatgcgcgcattcgataccgaattgaaggccggtgatctgttcctcaccaacccggtgattgccggcggtgaaacgcgcatgctgccgcagacttttcgtggtgtgagcctgagcaaccacagcttcgatggctggttgattgaaggtggtcaagcgagttttaccaagccttacaaccaaagcggtcacacacgcatcggcacgtcctacggaacattggcagatggcgacgagagccagcacctgaactgggccggtgtggcctggagcggtgtcgaaggcctgaccagcagtctttatgcctctgagctcaaggacatctggaaccagtactactacgacctggattacacttggcagttgaacgatctggtcagcctcaacccgggcctgcacttctatcacacgcaagacaccggtgatgcgctgctgggcaacatcgacaacaacacctacagcctgcatttcaccgttggcgtcggtaatcacagcgttaccgccgcgtatcagcgggtcaatggcaacacgccgttcgactacatcagccaaggcgacagcgtttacctcgacaactcccagcagtactccgacttcaacggcccgaacgagcgctcgtggaagctcaagtacgcctatgacttcgccggtgtcggcgtgccgggtctgacctcgtctgtgtcttactcgcgcggcactgtggacctgaccaaggtcgacgccgacagcaaaggctattccaactggtacagcgccgatggccgcaacgccaaacactgggaacgcgacctcgatctgaaatacgtcgtgcagagcggtcaggccaaggatctggcggtgcacctgcaatgggcgagcaaccgtggcggcaacggttacggtgcaattgattcggacacagatgaataccgcgtgatcatcgactacccgatcaacgtcttctaagatcggcgctaagctgactgcagactgactccgatagctcaaacaattaccaaccctgtgggagcgagctcgctcccacagtggaataccgtcactgaactcgtgcaactacgcttataagacttccctccaaccgatatccaatcatgatcgcgagccgtaccccacccgttgcgggcaagaccggacgccccgagttgctgctgatctgcggcagttcgctgaccgtgatcgcgattctatgcatcgtcaccttcctgctgatccgtgagcacgccaacgcgcaggaatcggcgacccgcagcgccaccaccattgcgcaactgatcgacgccgatgtgctgcgcacggtcgagttgtacgacttgacgctgcaaggtctgatcgccgccgcccagcgtgatgacctgcaaaatgtctcgccgcagatccgccatctggcgctgttcgaccgctcgaccacggcacgcttcaagggcgacatcctgctcctcgacaaacacggcgacgtgctcgccgactcttcgcgggtcgaaccgaaaccgggcaatttcgccgaccgcgactacttcctcgcccacgccttcaatcgcgatgtcggcatgtttatcagccgcccgttcaagacccgttgcgactgcgacgaggccaaccagtggcgcatcagcttcagtcggcgtatttcctcgcaaaccggtgagttcgccggtgtggccgtggcgtcgatgaaactcgactacttcgatcagttgttcaacagcctcgacatcggtaaagacagcacgctgaacatcatcgataacgacggtgttctgctggcgcagaagccctatctgcaaagcgattccatcggcaaaagcttcggtaacagacccaacgtgatacggattctgcgcgacaaggatggcaatggcagtttcaccagtacttcgagcatggatcatcaacagcgtctctatacctattcgcgagtcggcaatttgccgctgaccgtgatggtcgcgctgtccagcgatgaggtattcggcacttggcgccgcaccgcgttgttgatcagtggtgccacgggcgtgttgtgcgtgggtttgctgtggctgacctggctgctggcccgtgagttgcgccgacgtcagcgcgccgagcacgaactggcgcaattggccgctaccgatgcgctgactggcgtcgccaatcggcggatgctcgatcaggcgttgcgtcacgaatggttccgcgcccagcgctcaggcaaaccgatgtcggtgatgatgatcgatgccgaccacttcaaggcgttcaatgatcgacatgggcatcagggcggagatcaggcgctgaagacgctggcccgtgtcatcactgaaaatgtccggcgaccggctgatctggtcgcgcgttatggcggcgaggagttttcagtgattctggccgagaccgacggtcatggcgcgcagcagattgccgagcatattcgtcaggcggtggagcagttgccgctggtcgatgggggcgagcggccgatgacggtgagtattggcatcgcgacgtggacggcggcgagcgagatgacgctggaacagttgctgtttgcggcggacaaggcgttgtatcaggccaaggaaggtgggcgtaaccgggtggtggtggctgcctgatagatgtattggcttcaccggccctatcgcgagcaggctcactcctacaggggaatgcattccaaatgtaggagtgagaggacaccgccctttcacggcggtaacaggggttcgagtcccctaggggacgccacgattacccgctctgcgggattttataagggtcattcaattattgaatggcccttttgtttgtctggcgtttggccaattctcctttttccttacactgtgcttcagaccagcggtcatatccttgacttgcagaatattattatgcgaataatattctagtcgtaatattcggaggcaacgatgaacgataaaaaagctcaaacccgcgaacgcatcctcaaggctgccagctccgcactgattcagcgtggcccggcagaccctagcgtgggcgaagtgatgggcgcagccggcctgaccgtcggcggcttctatgcgcacttcgaaagcaaggacgcgatgatgcttgaagcgttcaagcaattgctcggtcgccgtcgcgacctgattgctgacatggacacgcaactgaccggtgaagaacgccgtgctctggtcgctgcgttctatctgtcacgcaagcaccgtgactccagcgaagcggcgtgccctattccggcttccattggcgaactgggtcgtttgccggactcgttccggcttgcgctgaacgaacacctggaattgatggtggcgcagttggcgtccagccctgaggacaccgataaagcgctggccgacatggccttgatggtgggtggtctggcactcgcaagagcgctgggtccgggagatttatccgatcgattgctgcgcgctgccaagtcggcggtgcgttgacctgaaggcaacacgcctgaggagagagcgatgaacacgttgaagtgggttcgtggcgttaatggcaccttgggctggattgcaccgaaacgggtggcgagcaaaatgcgtctggcgttcatgacgccgcgcgcgctgccactgcgcgaatgggaactgccgatgctggccaatgccgagcggattacgttgcgcttcggtctgtcggcactgcgctggggtcaaggtccgaccgtgctgctgatgcatggttgggaagggcggcccactcaattcgcctcgttgatcaccgcgctggtcgatgccggttacaccgttgtcgcgctcgatggcccggcccacggtcgttcgccggggcgtgaggccaatgtggtgttgttcgctcgggcgatgctcgaagcggcggcggagttaccgccgctgcaagcagtcatcggccactccatgggcggcgccagcgcgatgctcgccgtgcaattgggcttgcgcaccgaaaccctcgtcagcatcgctgctccagcgcgaattcttggtgtgctgcgtggttttgcccgatacgtcggtatgccgccgcgagcccgctccgcgttcattcgtcaagtcgagcaggatgtcggcatgcgcgctgccacgctggacgtcgcgcactatcaactggatatgcccggcctgatcgtgcacgccgaggacgacaacttcgtctcggtcaaagagtcgcaattgatccacgaatcctggttcgacagtcgcttgctgcgcctcgagggcggtggtcatcagcgcgtattggccgaccctcgggtgattgatggggtgttatcactgctggccggtcgcagcctccagacgcgccaatcggcgtgagctccgttacactgccccggttgaataactgaccgggagtggggcatgggctgggatcgggcaacgccgtttaccattgatctgcaagtaggcgccgaggacatcgacgggctcggccacgcgaacaacgcggtgtacgtgacttggctcgagcgttgcgcctggcgccattcgcagcgtctgggcctggatctggtcgaatatcggcggctggatcgggcgatggccgtggttcgtcacgagatcgattatctggccgccgcctatgaaggcgatgagttgcaattggcgacctggatcgtcgattgggatcagcgcctgaagatgacccggcatttccagctcaagcgcccgagcgacaacaccacgctgttgcgcgcgcaaaccactttcgtctgtatcgagctgtccaccggcaagccgaagcgcatgccggcagagttcatcgaaggttatggcccggctatcctgctctcagagtctgcgcaaatctaatgtaggagtgagcctgctcgcgatagcggtgtgtcagtcgaaacatatgtgactgatacaccgctatcgcgagcaggctcactcctataaggaatatgtgttgttctgcggatttgtgcgatatccagtaaactgccgcacgtttttcctcaagtagtgtttttcccatgcaaattgctctggcgcccatggaggggttggtcgacgacatcctccgcgacgtgctgacccgcgttggcggcatcgactggtgcgtgactgaattcattcgggtcaacgaccagttgctcactccagcgtacttccacaagttcggcccggagctgctcaacggcgcccgcaccgcatccggtgtgccattgcgtgtgcagttactcggttccgatccggtgtgcctggcggagaacgctgcgctggcctgcgaactcggctccgaagtgatcgacctcaacttcggctgcccggccaagaccgtcaacaagtcccgaggcggcgccgtactgctgaaagagccggaactgctcaaccagatcgtcgagcacgtgcgccgcgccgtacctgcgcacatccccgtgacggcgaagatgcgcctcggtttcgacagcccggacggttcgctggtctgcgctacggcgttggctgaaggtggcgccgagcacatcgtggttcacgcccgaaccaaaatggacggctacaaaccgccggcgcattgggagtggattccgcgtgtacaggacgtggtcaaggtcccggtgttcgccaacggcgatatctggagcgtcgaagactggcgccgttgccgcgaaatcagcggcgtggaagacatcatgctcggtcgcggactggtttcgcgccccgatctggcccaacagatcgctgctgcgcgcgcgggtgaagaagtcgtcgaaatgacctgggccgagctgatgccgttgattcaggacttctggctgcaagccaaagcgcagatgaccgcacgccaatcgccgggccgtttgaagcaatggctggcgatgctgacgcgcaattatcctgaggctacggagctgtttaccgtgctgcggcgcgagaccgagccggatcatgtctcgcgtttgctcggcctggcagtcgccgaagcggcctgaaaaaaatctgcaaatactctcttgaaatcatttcagcggtccctatttaaggggtacgcgatgccgaattcgggtcgcggagacaagaaaacttgctgatttttttcaggagatttgcaccatgagtaccgcattttccctcgcgccactgttccgttcctcggtaggtttcgaccgtttcaacgacctgttcgaaaccgccctgcgcaacgagccaggcagcagctacccaccttacaacgtcgaaaagcacggtgatgaccagtaccgcattgtcgtcgccgccgccggtttccaggaagaagacctggagctgcaagtcgagaaaggtgtgctgaccatcagtggcggcaaacgtgacgccaacgaaggcgtgaccttcctgcaccaaggcatcgcccagcgtgcattcaagctgtctttccgcttggctgatcacatcgagatcaaggcggcggatctgaaaaacggtctgttgagcatcgacctgttgcgagtgatcccggaagaggcaaaagccaaacgcattccgatcaacggggtggagaagccggttctgcaataagaccgagcaatgaaaagggcgccactggcgcccttttttgtgcccgtcattccagcagcactttcagatcctccagcgccaccggccgactgtgcaaataaccctgatacaaatggcagcccagcccttgcaggaatgccagttgctccggtgtttccacgccctcggcaatcacttccagctccagactgcgggccatggcgacaatcgcgcgaatgatctcggcatcgttggggtcagtggtcgcatcacggataaacgactggtcgattttcagcgtgtccactggcagacgcttgaggtaagtcagcgacgaataaccggtgccgaaatcgtccatggcaaaactcacgccgagctttttcagacgacgcattttgctgatggtgtcttccaggttctggatgacgatgccttcggtgatttccagtttcagcaacgagcacggcaggccatggctggtcatgctgtgttcgatgcgctcgacaaagtcgttctggcgaaactgtcgcgggctgatattgacgcacagactgaaattgagcgggtcgaccagtttcagcgcgatcagttgtttgaatgcattgcaggcttcgtcgaggatccacgtcccgacttcgagaatcagaccgctgtcttccagcactttgatgaactctgtgggcgattgtgcgccgagttccggatgattccagcgcaccagggcttcggcgccgatgatgcagttatcccgcgcgtcgatctgcggctggaagtgcacattgaattcaccgcgcgacagcgccaggcgcaagtcggtctccatgcgtagccgttcgctggcggccttctgcatggtgttgtggtacatctgcgtggtgttgcgcccggaatccttggcccgataaagcgcaatatcggcgcgtttgagcaggtcggtcggcgtcgagccgtgatcggggatcagcgccacgccgatacttggggtcacttgcagtcgctggccgtcgaggaacatcggttccgacagcaattcgcgcagggtatcggccagattgcgcacttgtgcgctgacttcgttgcgcgagccttcaaggccactgagcagcacgacaaactcatcgccgcccaggcgcgcaaccgtatcctccatgcgtacgctggcttcgagccgtgcagtaatgatcttcagcaccgtgtcgccgaccgggtggccgagggagtcgttgatgtgtttgaagtgatcgaggtcgagaaacagtaacgcgccgcgcaggttgtgacgcttgagcagggcgatctgctggctcaggcgatccatcagcagggcgcggttgggcaggttggtcagcgggtcgtggtacgccagatgacgaatctgcgcttcggcgtttttcagcaggctgacatcacgagcggtcaatagcaggcaggcggtttcgttaagggtgatcggttcgacggaaacttccaccgtcagcatctctccgcgtttgttgcgcccgagcatttcctggtggtgtacgcggcccttgatctgcagttcggccaagagtgccgagcgttgcttttcctcagcccagatgccgacctgatacacggttttacctaccacttcgtcggcgcgatagccggtgagcctgcagaagccatcgttgacctccagatagcgtccggtgtcgcgctcggtaatggtgatggcgtcggggctggagtgaaacgccttggcgaacttctcttcacttgccttgagtgccgcttctgagcgctgttgttgggtgatgtcgcgcagggtggtgacgatgcagggttgatcgccgacgctgatctgccggctggaaatcacgcaggtcagcgattggccgtccttgtgctgcacgatgatcgcgacattgctcaagccctgttcgcgaatcacccgttcaatgcgttgcagactttttgccgatgcgtcccacaggccgatttcttcggcggtgtggccaatcacgtcggcagcgctccagccgaaggtttgggtaaagctgttattgatttcgatgaactcgccactgtcctggcgggtgacgcagatcggatcggggctgacctgaaacagcgtggcgaatttttcttccgaggccaccagccgctgttcgcgctcgacctgatcggtgatgtccagcagggtgccggccatgcgcagcggtgcgccgttgtcgtcgcggtaaaggcgggcgcgactttccagatagcgcgagctgccgtcgggcagttgcacgcgataggtcagctgataattgcccgccgggccttcgcgcaggctgcggtaggcgtcgcgcatgctgtcgcgttcttcgccgggcaccccttcgaaaaactcgtcgaacgattcgtgaaatggttttggctccagcccgtgcaattgcgcagcccgcgctgagccgtaaagcatgccgctgggaatgtgccagtcccaggtgccgagctgcgcggagtccagcgccaggtcgaggcgttcctggctgtccttgagcgcatgttcggcggctttgcgttcggtggtgtcgaggaaagtgctgagcagatacggctggccttcgagttcgaccttctgggcgctgagaatgccgtcatgaatctgcccgttgctcgcgcgaaactgcacttccatgctgatcaattcgcccttggccttggttttcttgaccagttcggcgcgctgctccgggtgcacccacaggcccagttccagtgtggtgcgaccgatggcactctgcaccggccagccgaacaggctttcaaaatactgattggcctcgctgatcaggccgtcttcctggcgggtcagcaggaccatgttcgggcacaggtggaaaagtgtcgcgaaacgtttctccgaactgctcagggcctgttcgcgttggcgctggtgggtgatttcacgaatcaccccgatcattcgggggcggccgtgtttatccggcagcaggctgccgctgatctccagccagtgcaggctgccgtccggccagcggatgcggtggtgcatcgcctgttccagcggtgcgccggcaatcaccgcgtggaaggcgcggacggttttcgcgcggtcttccggcggcagcagatcgaggtattccagatcttcgggcagcggttgccgaggatcgaagccgaacaatgcctgggtgccacgcgaccaactgatctgcccgcgctcgatgtcccaataccaggcgccgagccgcgcgccgttgagtgcggcgagcaattggggcgcactctcccagctctgctcggaatgacgcgggtcaatggcctgaatacgcggcatcggcggaattcggtcaacagatttcggcatcgttaacaggccttgagctgatggtggcattaggcacagggacagcggctctataggagtagcacaagttggcctcaagtccctggcagatcgatttgtgcgtccagcaaggccataaacgctcttgctgcattcgatagcgtccgttcggtgtgcaagatatagcctagctggcgactgagctgtatgcccggcaatacgatgctcgccacttgatcgtcgagcatggtgcgcggcaaaacgctccaggccaggccaatcgagaccatcatcttgatggtttccagatagttggtgctcatggcgatgtttggcgtcaggccctgagcctcgaataaacgttggacaatgtggtgcgtgaaggtgttgcctccggggaaaaccgccggatgaccggcaatgtccgccagactgacggcaccgttattgatcagcgaatgctctggggcgaccacaaaatccagcgggtcgtcccaaacgggcgtggctttgaccagtgcgtgcggctccggcgcaagggtgatgaccgccagttccgcgcggccatggagaatttcctcgtaggccacttccgaatcgaggaactgaatatccagcgcgacctgtgggtaacggcgggtgaattcccttaacagcggcggtaaacggtgcaggccgatgtgatgactggtggccagggtcaggcggccgctgacttcgccggtcaggttggtcagtgcgcggcgggtgtcgtcgagcacgttgagaatctgatacgcccgcggcagcagggcgcgcccggcctcggtcaggccgacttcacggcccagccgatcaaacaggcgcaccttcaattgttgctccagcccggcgatgcgcttgctgatcgccggttgcgtcaggtgcagccgttcgccggcgttggagaagctgccggtctcggcaatcgcgataaaagcgttgaggttggccagatccatggttgtattccagttggttatccaaagcataaaaaatatgaatttgagttatttaatctaaccccatacgatcggcctcacaagccaaagggttattgataagcccagggcatagaaacaagctgatgaggaaccgtctgatggccggcaaaacgctctacgacaagctctgggattcgcatttggtcaagcagcgcgacgatggctcggcgctgatctatatcgatcgtcacatcattcacgaagtgacctcgccgcaagcctttgaaggcctgcgtctggccgggcgcaagccttggcgcatcgatgccaacatcgcgaccccggaccacaacgtaccgacgactccagagcgcaagggcggcatcgaagccattgccgatcaggtctcgcgtttgcaggttcagaccctcgacgacaactgcgatgaatacggcatcgtcgagttcaagatgaatgacgtgcgccaaggcatcgtccatgtgatcagcccggagcagggcgcaaccttgccgggcatgaccgtggtttgcggcgactcgcacacctcgactcacggcgcgttcggcgctctggctcacggtattggcacttccgaggtcgagcatgtgctcgccactcagtgcctggtcgccaagaaaatgaaaaacatgctggtgcgcgttgaagggcaactgccgttcggcgtgaccgccaaggacatcgtcctcgcagtgatcggcaagatcggcaccgctggcggcaatggccacgccatcgagttcgctggcagcgcgatccgcgacttgtccgttgaagggcgcatgaccatctgcaacatgtccatcgaagccggtgcccgcgtgggtctggtggcagcggatcagaagaccgtcgattacgtgaagggccgtccatttgccccgaaaggcgcggaatgggacatggctgtcgaagcctggaaagacctggtctccgacgctgatgccaaattcgacaccgtggttgaactcgacgccgcgcagatcaagccgcaagtcagctggggcacgtccccggaaatggttttggccgttgaccaaaacgtgccggatccagcgaaagagatggatctggtcaagcgcgactcgatcgtccgcgctttgaaatacatgggtttgaccgccaatcaggcgatcaccgacattcaactggatcgcgtgtttatcggttcctgcaccaactcgcggatcgaagacttgcgcgctgcggcggtgatcgccaagggccgtaaagtcgcatcgaccatcaagcaagcgatcgttgtgccgggctcgggtctggtcaaagcgcaggctgaggccgaaggtctcgacaagatcttcctcgaagccggtttcgaatggcgtgagccgggttgctcgatgtgcctggcgatgaacccggaccgtttggagtccggcgaacattgcgcctcgacctccaaccgtaacttcgaaggccgtcagggcgccggtggccgcacccacctcgtcagcccggccatggcggctgcggctgcggtgaacggtcgtttcatcgacgttcgtgaattgatctaaaggagcgcagcatgaaagcttttacccagcacactggtcttgtcgcgcctttggatcgtgccaacgtcgacactgaccaaatcattccgaaacagtttctgaagtcgatcaagcgcaccggttttggtcctaacctgttcgacgagtggcgttatctggatgtcgggcaaccgtatcaggacaactccaagcgtccgctgaacaaggacttcgtccttaacgccgagcgttatcaaggcgccagcgtgttgctggcccgcgagaacttcggttgcggctccagccgtgaacacgcgccgtgggcccttgaagaatacggtttccgcagcatcatcgcgccgagctacgccgatatattcttcaacaacagcttcaaaaatggcttgctgccgatcatcttgagcgacgctgaagtcgatgagttgttcaagcaggttgaggctgagccgggttatcaattgcaggttgatctgcaagcgcagaccgtgacccgtccggatggcaaggtgtacagctttgagattgatgcgtttcgtaagcattgcttgttgaatggtctcgacgatatcggtttgaccttgcaggacggtgatgcgattgcgacgtttgaggccaggcatcgggttagccagccgtggttgttccgtgacgcgtgattgattcgaggttgatgtagtcagggccggccccttcgcgagcaggctcgctcccacacttgaaatgcattcccctgtgggagcgagcctgctcgcgaagacggcagcccgaacaacacaaatatcaggatgtgaccatgaccagcaccgcccaacacactcaggtcgtacaaaagcaattcggtgaacaggccgccgcctacctgagcagcgccgttcacgctcaaggcaccgaattcgcactgctacaagctgagctggccgggcagggcgaagcgcgggtgctggacttggggtgtggcgccggtcatgtcagttttcatgtcgcaccgctggtcagggaagtggtcgcctacgacctgtcgcagcaaatgctcgacgtggtcgccgccgctgcgattgatcgcggtatcggcaacatttccacggtcaacggtgccgccgagcgtctgccgtttgccgatggcgagttcgacttcgtgttcagccgttattcggcgcatcactggagcgatctcggcgtggccctgcgcgaagttcgccgggtgctgaagccaggcggtgtggcggcgttcgtggatgtgttgtcaccgggcagccctttgttcgacacttatctgcaaagcgtcgaagtgctgcgtgacaccagccatgtgcgcgattactccgccgctgagtggttgcggcaggtcagcgaggccggtttgcatgtgcgcagcaccacgcggcagcgcctgcgtctggagtacaccacctgggttgagcgcatgcgcacacctgaagtgatgcgcgcagcgatccgccagttgcagcagtcgatgggcaacgaagtgcgcgaatattttgagattgatgccgacggctcgttcagtaccgatgtgatcgtactgatggccgagcgctaaaaatttttccgggcgcgcctgagatggcgcaccgactgaagacacgaggaaagcatgagcaagcagattctgattctcccaggtgacggtattggtccggaaatcatggccgaagcggtcaaggtgctggaactggccagcgacaagtacagcctgggcttcgagctgagccatgacgtgatcggtggcgccgccatcgacaagcacggcgtgccgctggccgacgaaaccctcgaccgtgcccgcgctgccgacgccgtgctgctgggcgccgttggcgggccgaaatgggacaccatcgagcgtgatatccgccctgagcgcggcctgctgaaaatccgtgcgcaactgggcctgttcggcaacctgcgtccggcgatcctgtacccgcaactggctgacgcttcgagcctgaagccggaaatcgttgccggtctggacatcctcatcgttcgtgagctgaccggcggcatctacttcggcgcaccacgcggcacccgcactctggaaaacggcgagcgtcagtcctacgacacgctgccgtacagcgaaagcgaaatccgtcgcatcgcccgcgtcggtttcgacatggctatggttcgcggcaagaagctctgctcggtggacaaggccaacgtattggcctccagccaactgtggcgtgaagtggtcgagcaagtggccaaggattacccggaagtcgaactgagccacatgtacgtcgacaacgccgccatgcaactggtgcgcgcgccgaagcagttcgatgtgatcgtcaccgacaatatgttcggcgacattctgtccgacgaagcgtcgatgctcaccggttccattggcatgctgccttcggcctcgctggactccaacaacaagggcatgtacgagccttgccatggttccgctccggacatcgccggtaaaggcattgccaacccgttggcgaccattctgtcggtgtcgatgatgctgcgttacagcttcaatctgcacgacgcggccgatgccatcgagaaagccgtcagcgttgtgctcgatcaaggcctgcgtactggcgacatctattcggccggttgcagcaaagtcggtacgcaggaaatgggcgacgcagtagtcgccgcgctgcggaatctgtaatctctcgggcccgctgcgaaattcaatacaaagcagcggcccacttttcaagaaggtgtagttgcgatgaaacgtgtaggtctgatcggttggcgcgggatggtcggttccgtgctcatgcagcggatgctggaagagcaggatttcgatctaatcgagccggtgtttttcaccacgtccaacgtcggtggccaaggcccgtccgtgggcaaggacattgctccgctcaaggatgcttacagcattgatgagctgaagaccctcgacgtgattctgacctgccagggcggcgactacaccagcgaagtgttcccgaagctgcgcgaagccggctggcagggttactggattgatgcggcctcgagcctgcgcatgaacgatgacgcggtcatcattcttgatccggtcaaccgcaaggtcatcgaccagcaactcgacgcgggcaccaagaactacatcggcggcaactgcaccgtcagcctgatgctgatgggcctgggcggtctgttcgaggcgggtctggtcgagtggatgagcgccatgacttatcaggcggcctccggtgccggcgcgcagaacatgcgtgaactgatcaagcaaatgggcgcgacccacgccgctgtcgctgatcaactggccgatccggctagcgcgatcctcgacatcgaccgtcgcgtggccgatgccatgcgcagcgaagcgtacccgaccgaaaacttcggcgtaccgctggccggcagcctgatcccgtggatcgacaaagagctgccgaacggccagagccgcgaagagtggaaagctcaggccgagaccaacaagatcctcggtcgcttcaagagcccgatcccggtcgacggcatctgcgtgcgcatcggtgcgatgcggtgccacagccaggcgctgaccatcaagctgaacaaagacgtaccgatcgccgatatcgaagggctgatcagccaacacaacccttgggtcaaactggtcccgaaccagcgcgaaatcagcatgcaggagctgagcccgaccaaggtcactggcaccctgaatgttccggtggggcgtctgcgcaagttgaacatgggttcgcaattcgtcggtgccttcaccgtcggcgaccaactgctgtggggcgcggccgaaccgctgcgtcgcatgctgcgtatcttgcttgagcgttgatcgcctgaagcaatgaaagaacccgtgccttgtgagaggtgcgggtttttttatgccgatcgttcccacgctctgcgtgggaatgcatcccgggacgctccgcgtctcttttcaagccgaacgcggagcgtccgatgcggcattcccacgcggagcgtgggaacgatccgggtgggcagaaattgcctgtgcgccagtcacccggtaaagtgccgctccccccgtttcgccagaggctcgcaccatgacccagaccctagatattgccgtgatcggcgccaccggtactgtcggcgaaaccctcgtacagattctcgaagaacgcgacttcccggtcggcaacctgcacctgctggcgagcagcgaatctgccggcagctcggtgctgttctgcaacaagaacgtacgcgttcgcgaagtcgacgagttcgatttcagcaaggtcaaactggtgtttttcgccgcgggcccggccattaccttgagctacgccgcgcgcgcccatgctgccggttgctcgctgatcgacttgtccggtgcattgccagccgatcaggcgccgcaaatcgttccggaggccaaccccgctgtgctcgccggtttgaaggcgccgttccaagtcagcagcccaagcccatcggccacttcgctcgccgtggtgctggcgccgctgctcgatctgatcgacctgcaatacgtgaacgtcaccgccaatctcgccgtgtccgcacagggtcgtgaagctgtgaccgagctggcgcggcagaccgccgagctgctcaacatgcgcccgctggagccaaccttcttcgatcggcagatggctttcaacctgctggcgcaggtcggcacgcctgacgcacagggccatacgctgctggaaaaacgtctggtgcgcgagttgcgtcaggtgctggcacagccttctttaaagatttccgcaacttgcgttcaagccccggtgttttttggcgatagctttagcgtgaccttgcaatcaaagcgcgcagtcgacctggaaaaggtcaacgcggcacttgaagatgcgccgggtattgagctggtcgaggccggtgattatccgaccgccgtgggtgacgcggtaggccaggacgtggtctatgtcgggcgcgtgcgcagcggagtcgacgacccggcggaacttaatctgtggctgacgtcagataacgtacgcaaaggtgcagcccttaacgctgtgcaggtggctgaattgttgataaaagacctgctgtaaaagatacttggcaacaatttgtcgactgattctaggtgagcgctatgcttgcccggagcgctggataacgtgtcaccctccgggactttccggggcatcaaagaaatgagcgcgcgcgacatctgtcgtcgtcgcgcgcaatgccttacggcagcggcaatcaatatcttctcgctggccgaggaacgttcaaacaaaggatgaggctatggttcaagttcgcaaactggtgttagcaatagcggccgcctcggcgctgtcctccggtatggcgcatgccctcgggctcggggagctgaccctgaagtcgaccctgaaccagccgctggtggctgaaatcgagctgctcgacgtcaaggatctcactgctgccgaagtggtgccgagcctggcttcacccgaagatttcgccaaggccggcgtcgatcgccaggccttcctcaatgacctgactttcactccggtgctcaacgccagcggcaaaagcgtgctgcgcgtaacgtcgagcaagccgttgtcggaaccgatggtgaaattcctcgtgcaggtgatgtggccgaacggtcgtctgctgcgcgattacagcgtgctgctggatccatcgaagttctcgccagagaccgctgacgccgccgcacaaccggcgccgtcgcagaccatcgccgcaccgaccacgggcgccacacacccgacgcaatacaccaccacgccgcgcgataccctgtgggagattgccgcgaaggcgcgcaacggtggttcggtgcagcagaccatgctggctattcaggcactgaatccggatgcgttcattggcggtaacatcaaccgtctgaaaaccggtcaggtgctacgtctgccggattcggtgcaaagcactgcattgccgcagtcgaaagcgattgccgaggtcgcggcgcagaacgaagcctggcgcacgggccgtcgctatgtggccaagcccggcaccggtcagcagcagctcgatgcgaccaaccgtggtcgcggcaataccgctggagcacagaacgcccaggacaatctgagcctggtctccgccgagagtgccaaggcgcgcggcaaaggcccggcaggtgacgcccaagccttgagcaacaagcttgcagtcactcaggaaaacctcgacacgacccgtcgtgacaacgaggaactgaaaagccgcatgtccgatctgcaaagtcagatggacaagctgcaaaagctcatcgagctgaagaacaatcaactggcgaaactgcaggccgaaggcgcgggcgctgccccggccgcgaatggcgcagtcgcgccggttccggcgatcactgctgagctggctgccacaccgccggctactcctgcagaagcagcgccgacgccagaatctgccattgctccacctgccgaaacgccggttgagccagtggtcgagccggttgtcgaaaccaaacctgcggctgatgatgaaaaaaccttcaatgagctgctgaccaatccgatcctgttgggtctgatcggtggtggtgcggtggttctgctgctcctgctgttgctgttggcacgtcgccgcaaagctcagcaggaagctgaaaagcatgtgcgcatggctcgtgcgctggccgaagaacaagagttctccgccgagcaggatctgccggaaagcagcttcgaaggtctggaaacgccagcggcgagcgtcaagctcaacactccggcgcctgctcctgctccagtcgtggctccggtagtggcgccgatcgtgatggctgagccgattgccgcgccgctggtggcgccggccgccgagcgttccgatgacgtgctcgacaaggcgcaatcgcacatcaatgccggtcgcctgaatcaggctgcagcattgctggaggagggcgtcagcctcgagccgcaacgcagcgatctgcgtctgaaactgatggaagtctacggtcagcagggcgatcgcgatgcgttcgtcggccaggaacgtcagttggtggccaatggcgacaactttgccaaggtcgaagaactgaagagtcgcttcccggcgatggccgtcgtcgctgcttcggggctggccgctgctgccgtggctgctgagctggatgcacagtacgtcaaggaactgttgctggatgagcctgaagcgcctgcgccagcgcctgttgaagatgacctggacagtgcgtttgacctgagcctggacgatctcgacaacatcacgccagttgagccagcgcctgtggttgagcccgaagcgccggtcgagctggacgaattcccgtccgacgatgacctgagcttcgagtcggtgctgcaacagcagaccgacatcaaagagaatctggatgacctgtcggacttcgatctggatctggatctcggtgccgagccggcggctcctgcggctgatctggcggacgatgacttcctgctggatctggacgaaggcgtgaaggatctgcctccagtcgaggcgccggtggtagctgacgtgccgcaggatgatctggaactgccggctgatttcgatctgtcgctggccgacgaaatggacagcaatccggcggctgagcctgacgcattcgcagcagaactggatgacgtcaacgccgagctggatcgtctgtcgcaaagcgttgccgaaccgaccttcactgaagccgatgcggcaatcggtggtgatctgggtgaagacgatttcgacttccttgccggcaccgacgaggccgcgaccaagctcgatctggctcaggcctatatcgacatgggcgatgccgatggtgctcgcgacatcctcaacgaagtgctgaccgagggtgacgagaaacagcgtggtgaagccaaggaaatgctctcgagcctgtagtcaatctgcggtaaacaaaacggcagcccattgaggctgccgtttttgtttgtgccggattcagtggtgtctgaaggattgctatcgcgagcaggctcactcctacatttggaatgcgttcccctgtaggagtgagcctgctcgcgatagggccagaactgccaatagagagttctggcatccctgaaccacagccttataatgcccgcctttgcaaaaacagcaggctgtcccaccttggcaaacatagataacccggtcgccgaaatggcccccgacggcttttaccgcgtagcgctgggcgttgagtacaaaggctcgcgctacagtggctggcagcgtcagttgacgggtgtgaagacggtgcaggaagagctcgaaaaagccctgtcgaaagtcgccaactcgccggtctccttgcagtgtgccgggcgcaccgatgccggcgtgcatgcttgcggacaagtggtgcactttgataccacggttgatcgttcgctgaaagcctgggtcatgggcgccaatatcaatctgccccacgacatcagcgtcagttgggcgcgggtgatgccggcgcatttccatgcgcggttcaaagccatcgcccggcgctatcgctacgtgatctacaacgatcagattcgcccggcgcatctcaatgaagaaatcacctggaaccaccgtccgctggacgtcgagcgcatggccgaggccgcgcagtacctgatcggtacccatgatttcagtgcctttcgcgccggccagtgtcaggctaagtcgccgatcaagaagatgcatcacctgcgcgtgacccgtcacggcaagatgatcgtgctcgacatccgcgccaatgcattcctgcatcacatggtgcgcaacatcgctggcgtactgatgaccatcggtgcgggcgagcgtccagtcgaatggatgaaggaagtgctggaaagccgcgagcgccgctctggtggggtgaccgcgcatccgtacgggttgtacctggtgcaagtcgagtaccacgacgaattcccgttgcccgagcgttttatcgggccacatttccttacgggtttctccgaacttgacggctgacgccttcgaacgcttttgttaccatccgggactttcccggattttgccttggagtttttctcgacatgccagccgttcgcagcaagatctgcgggattacccgcatggaagatgcgttggccgccgtcgaagccggggctgatgcgatcggtttcgtgttttacgccaatagtccacgcgcggtgagcgtgcagcaggcgcgtgcgatcatcaaggcgttgccgccgttcgtgaccaccgtgggtttgttcgtcaatgccagccgctgcgagttgggggaaatcctcgatgcggtgccgctggatctgctgcagttccatggtgatgaagtcgctgaagactgtgaaggctggcaccgtccgtatatcaaggcgttgcgggtcaaggctggcgatgacatcgcggcggctgtcgatgcctacccgagtgccagtggcgtgctgctcgacacttacgtcgaaggcgtgcccggcggaaccggtgaggcgttcgactggtcattgattccgcaaggtttgagcaagccgttgattcttgccggtggtttgacccccgagaacatcgccgacgccgtggcgcgggtaaaaccctacgcggtagacgtcagcggtggagtagaggcgagcaaaggcatcaaggatcacgcaaagattcgcgcattcatcaacgctgcacgcaaagctccatattgatgtgacggctggcagtctgccgccgtccatcaatgcacttgcacaaagcaggcgcggctgagggtttggggatagcacgcaggtcatgtttcgcgctgaccgtggctgtccgtcaaccatcgccacacacatgaatttagctgaagggcatacgcggggctgcgaaccagagcgttcgggccgccggtactggagaaaaaaagcatgagcaactggttggtagacaaactgatcccttcgatcatgcgttccgaggtcaagaagagctcggtccctgaaggtctgtggcacaaatgcccgtcttgcgaggcggtgctgtatcgtccagagctggaaaagaccctggacgtttgccccaagtgcaaccaccacatgcgcatcggcgcacgtgcgcgcatcgacatcttcctcgatgccgaaggtcgcaacgaactgggcgccgatctggagccggttgaccgtctgaagttccgcgacggcaagaagtacaaggatcgcctgaccgccgcacagaagcagaccggcgaaaaagacgcgctgatttccgtcagtggcaccttgctgggcatgccggtggtggtttcggcgttcgaattcgccttcatgggcggttcgatgggtgccatcgtcggtgagcgcttcgtgcgcgctgccaactacgccctggaaaaccgttgcccgatgatctgcttcgccgcttccggcggtgcgcgcatgcaggaagcgctgatctcgctgatgcaaatggccaagacttcggccgtgctggcgcgtctgcgtgaagaaggcattccgttcatctccgtgctgaccgaccctgtctacggcggtgtttccgcgagtctggcgatgctcggcgacgtgatcgtcggtgagccgaaagccctgatcggcttcgccggtccgcgcgttatcgagcaaaccgtgcgtgaaaaactgccggaaggcttccagcgcagtgaattcctgctggaacacggtgccatcgacatgatcattcaccgtcaggagctgcgcccacgtctgggtaacctgctcgcacagatgaccggcaagccgacgccgaaattcgtcgccgcgccaatcgagccgatcgtggttccgccggtacctgctggcctatgaccgagcgcacccttggcgagtggctcgcctaccttgagcagttgcatccatcggccatcgacatgggcctggaacgttcgcaacaggtagcgtcccggatggggctgggccagccggcgcctcgggtgattacggtcaccggcaccaacggcaagggttcgacgtgcgcattcgtggcttcattgctgcgcgcgcagggcctgagcgttggtgtctacaattccccgcatctgctgcgttacaacgagcgggtgcagctcaatggcgtcgaagccactgacgcgcagctgtgcgaagcctttgctgcagtcgaggccgggcgcggcgacacttccctgacttacttcgaaatgggcactctcgcggcgttctggctgttccaacaggccggactcgatgcggtggtgcttgaagtcggtctgggcgggcgtctggacacggtcaacgtggttgatgccgatatcgcactggtcaccagcattggcgtcgatcacgccgattatctgggtgatacccgtgaatccgtggctttcgaaaaggccggtatcttccgtcagggcaaacctgccttgtgcggcgatctgaatcctccgcaaccgctgctcgacaaggcgcgtgaactggcctgtccgttcttcctgcgtggacgcgatttcgaccttggcatcaccgatcagcactggcagtggcgcggcaccgatgcgcaaggtcaggctgttgagctgcatgacttgccgctgctcgatctgccgatggaaaacgccgcgctggcgttgcaggcgtacctgctgcttggtttgccgtgggatacgcagcagatcgtcgtcgccctgcaggcgacgcgcgtggtcgggcgccttgatcgccgctcgttcgattggggcggcaagcgcctgaatgtgttgctggatgttggtcacaatccgcatgccgccgagtatctggcccgtcgtctggccgcgcggccgccagtcggcaagcgtttggcggtatttggtctgctggctgacaaggatctggatggtgttgtcggcgaattgagtgctagtgtcgcgcactgggcagtggcgccgctggattcgccgcgagctcgcccggtagctgaattgcaggcggcattgcagaaccttggtgcgtcggtcacgtcttacgacagtgttgccgccgcgctggaagggcagtgcgccgtagccaccagcgacgacgagattctgttgttcggatcattttattgtgtcgccgaggcccttgaatggctggcccggcgctccacggaggaagcggcaaatggctttgctggataaagcgtacaagcagcgcatggttggcgccttggtgctggtggcgctggcggtgattttcctgccgatgctgttttcccgtcaggatgagcaacgtcaggtgaccgttgaggcgccggctgctccgcaagcgcctgccatgccgcaagtgcaaatggaagcggtcgccgtgcctgagccgcaagccttgccgcaagagccagtgccaacggatgaagaagtcgcagaagatactgcgcctgctgcacctgttgcgcctgcgccgacggctcccattatgatcaccaagcctgttgcgcctcccgcggtggccaagccgattcctgcgcctgctcagccgatcactgcgtcctcgtccaggccggacacaacgcaaagccgcgtcgatgccaacggtctgtcggtgagctggtcggtgcaactggccagtctgtcgagtcgtgccagcgccgaaagcctgcagaagaccctgcgcagtcagggctataacgcttacatccgctccgccgacggcaagaatcgggtgtttgtcggcccgctgatcgagcgtgccgaggctgatcgtctgcgtgatctgttggggcgtcagcagaacctcaagggttttgttgtgcgcttccagcctgagcgcggctaaaaactatcgcctcgattgaaatgcactgacaatcgcagcttaccgagaggcatgcgctctgctaaaatgcgccgccttatccgtctgtaggctgcactgtgccatttacctgggttgactgggcgatcgttgtaatcatcgccatctccgctttgatcagtttgagccgcggcttcgtcaaggaagcattatcgctggtgacctggatcatcgcaggagccgtcgcctggatgttcggtggctcactgtccgagtacctcgccggatacatcgaaaccccatcggctcgcgtgatcgcgggctgtgccatcatgtttgtcgccacactgatcgtgggcgcaatgatcaattatcttatcggcgagttggtacgtgtcaccgggttgtccgggaccgatcgattcctcggcatggccttcggcgctgcgcgtggcgtgttgctggtggtcgtggcggtcgggctgttgagtctggggccggtacagcaggacgggtggtggaaagaatcacagctcgtaccaaagtttctattggtcgccgactggtccaaaaacctgatactcgggtggagcagtcagtggcttgccagcggaatcagcgtacccgctgatattccgttcaaggagcaactcttgccgtcggcgaaaacgcctcagtgagtgttgttcagttcagatccattaagtaggggttgcgtcgcatgtgtggcatcgtcggtatcgtcggtaagtcgaacgtcaatcaggcgctgtatgacgcgctaaccgtgctccagcaccgcggccaggacgctgccggtatcgtgaccagccatgatggccggttgttcctgcgcaaggacaatggcctggtgcgtgacgtgtttcaacagcgtcacatgcagcgtctggtcggccacatgggtatcggccacgtccgttacccgaccgcaggcagttcgacttcggccgaagcccaaccgttttacgtcaactcgccttacggcatcaccctggcgcacaacggtaacctgaccaacgttgaacagttggccaaagagatctacgaatccgatctgcgtcacgtcaacaccagttccgactcggaagtgctgctcaacgtgttcgctcacgagctggcccagcgtggcaagctgcagccgaccgaagaagacgtgttcgctgccgtgactgacgtgcacaaccgttgcgtcggtggctacgccgtcgtggcgatggtgaccggttacggcatcgtcggtttccgcgacccgcacggcatccgtccgatcgtgttcggccagcgtcacaccgacgaaggcgtcgagtacatgatcgcctcggaaagcgtttcgctggacgtgctcggttttaccctgattcgcgacctggcaccgggcgaagcggtctacatcactgaagacggcaagctgcacacccgtcagtgcgcgaccaacccgtccctgaccccgtgcatcttcgagcacgtctacctggcgcgtccggactcgatcatcgacggcgtatcggtctacaaggcccgtctgcgcatgggtgagaagctcgccgagaaaatcctgcgcgagcgtccagagcacgacatcgacgtggtgatcccgattccggacaccagccgtacagccgcgctggaactggcgaatcacctgggcgtgaaattccgcgaaggtttcgtcaagaaccgttacatcggtcgtaccttcatcatgccgggtcaagcggcgcgcaagaagtcggtacgccagaagctcaacgccatcgagctggaattccgcggcaagaacgtgatgctggtcgacgactcgatcgtgcgcggcaccacctgcaagcagatcatccagatggctcgcgaagccggcgcgaaaaacgtctacttctgctcggctgctccggcggtacgcttcccgaacgtctatggcatcgacatgccaagcgctcacgaattgatcgcgcataaccgttcgacgcaggacgtggcggatctgatcggcgctgactggttgatctatcaggacttgcctgacttgatcgaagcggtcggtggcggcaagatcaagatcgagaacttcgattgtgcggtgttcgacggcaagtacgtcaccggcgatgtcgacgaggcgtacctgaacaagatcgagcaggcgcgtaacgactcctcgaagatcaagacccaggcggtcagtgcgatcatcgatctgtacaacaactgagtttctaccggccctgaggggccggttttgtatctgactttcaattttcgagaacagcgcaaggagtgacagcatgagtcaggaatgggatgccggtcggctggacagcgaccttgaaggcgtagcgttcgataccctggccgtacgtgccggtcagcaccgtacgccggaaggtgagcacggtgatccgatgttcttcacctccagctacgtgttccgcaccgctgccgatgcggccgcgcggtttgccggcgaagtgccgggcaacgtgtactcgcgttacaccaacccgaccgtgcgcgcgttcgaagagcgcattgctgcactggaaagcgccgagcaggctgttgcgaccgcaaccggcatggctgcgatcctggcagtggtgatgagcctgtgcagtgctggcgatcatgtgctggtctcgcgcagcgtgttcggctcgaccatcagtctgttcgagaagtacttcaagcgttttggcgtggaagtcgattacgtgccactggccgacctttcgggttgggatgcggcaatcaagccgaataccaaactgctcttcgttgagtcgccgtccaaccctctggctgagctggttgatatcgccgcactggcagaaatcgctcatgccaaaggcgcgatgctggtggtcgataactgcttctgcaccccggcgttgcaacagccgctgaaactgggggcggacatcgtcgtgcactcggcgaccaagttcatcgacggccagggccgttgcatgggtggggtggtagccgggcgtagcgagcagatgaaagaaatcgtcggcttcctgcgcactgccgggccgaccctgagtccattcaatgcgtggatcttccttaaggggctggaaaccttgggcctgcggatgaaggcgcattgtgccaatgcccaggagctggctgaatggctggagcagcaggacggtatcgagaaagtccattacgccggtctcaagagtcatccgcagcacgaactggctcagcgtcagcagaagggcttcggtgcggtggtgagctttgaggtcaagggcggcaaagagggcgcctggcgctttatcgatgccacccgtttgatttcgatcaccgccaaccttggtgacagtaaaaccaccatcactcacccgagcactacttctcacggccgtctcgcaccgcaagagcgtgaagcagcgggcatccgtgacagcctgatccgcatcgcggtcggtctcgaagacgtggcggatctgcaagccgatctggcgcgcggtctggcagcgctgtgatcgagttgtcgacgccgacagcgggtacccatggccgcgtcgcgttggtcacgggtgccgcgcgcggtattggtctggggattgcggcgtggctgatcagcgaaggctggcaagtggtgctgaccgatctggatcgtgcgcgcggttcgaaagtggcgaaggtgctgggcgaaaacgcctggttcattgccatggacgttgccgatgagggccaggttgcgctgggtgttgctgaggtgttggggcagtttggtcgtctcgacgcgctggtatgcaatgcggcggtcgccgatccgcacaacatcaccctggaaagcctcgatctggcttactggaatcgcgtgctggcggtaaacctcagtgggccgatgttgctggccaagcactgtgcgccttatctgcgcgctcacaatggttcgatcgtcaatctggcctcgacccgtgcgcggcagtcggaggcggactccgaggcgtatgcggcgagcaagggtggattattggcgctcacgcatgcgctggcaatcagcctggggccggagattcgcgtcaacgccgtcagtccgggctggatcgatgcgcgtgatccctctgcgcgtagagccgagccgttggccgatgccgatcatgctcagcatccagcgggcagggtagggacagtcgaggacgtggcggcgatggttgcgtggttgctgtcgaggaatgccgggtttgtcaccgggcaggaattcgtcgtcgatggcggcatgacgaaaaagatgatctatagcgagtagatcgccttttactgtgaatttgcgttgaatgaactggcgccttcgcgagcgggctcgctcccacatttggaatgcaatcccctgtgggggcgagcttgctcgggaaggcggtcttgcaggatggaagcaatttcgtcttttttagaaaaacttcaatcctgctattgacttaggttctctacctgcgtaaatttcgcggcctcggagatgcaaacgggtgattagctcagctgggagagcgtctgccttacaagcagaatgtcggcggttcgatcccgtcatcacccaccactccgcgagagacttgcgtaagcaagagcgtaggctgaaagtgcctgcaccgacgcgcagcggtagttcagtcggttagaataccggcctgtcacgccgggggtcgcgggttcgagtcccgtccgctgcgccatattttacgaatcaggcttgtctggttcgcgattgccaagcaccgaagctagcagtcaaaacgagttacttgagcgcaagctcaaagcgatacgcagcggtagttcagtcggttagaataccggcctgtcacgccgggggtcgcgggttcgagtcccgtccgctgcgccatatctgctccaaggaccactgaacgccttgaagcaccgaaagcaacccttggttgattcggaatcgatagcaaagaccctggtcgaaagaccggggttttttgtgtctggaatttggctattaccttcttttcctcccgccccaatcccgaagccaacacaaatccctgtaggagtgagcttgctcgcgatagcgtcagttcagccatgctgctggtgactgacactccgccatcgcgagcaggctcactcctacaagtgtctacccgcctgctgcggtctcacgtcgcattgattttttgattctttagtcaaatttttgtatctggttgtttgctgcgagcccagaaacctttaaagttaacctttcggtcagctttgcactgtcatcacgcctttcgtttagccaagaagggcttctgcaagactcgagattcccagtagataaccagaagggcggacacataaccgcccagaggatgatccatgtccaaccgtgatatatcccggcgctcgttcctccagggcgggctggtggcgggcgtgagcgtcacgctcacgccactcagcacccaggcgctggctgccttgatggaaaacagcgtaaccgtgccgtccgagaaatggctcggcaacaacggcaaagcgcgtcagcgtaacgatgcgctgtccaaggtctgcggcagcaaagtctttgctcgcgacattcgctccaaggacatgccgggctggcccgagcagcaaggccacgccatgttgctgaaaaccatcaaggctgaccgcatttacgacggttacgacctgtcgtggcttggcgctgacttgcagcctgaccgtatcgtcaccgccgccgatctggacaaggacggcatcgtcttcccggaagaacatgcgccggatccactgctgccagaaggcaaggtgccaatgttcatcggtcacccggtggccatcctgatctggaacgacttcgagcgcttccgtcaggccaagaacaaactcaaattcaatgacagagcgattcgttacggtgccaaagtaccgttctacgaaggcgacccctacggcagcttccgctatgtgcgcgttggcggcgcgacctcggcagacgaagatgaattcgccagcctcaaggactcgatcctgttcccgatgctgaagaaccgtcgtccggtgtggaattcccagccgaacctgcacggcaatctgaccgagcgcgggctgttctacgctgaccgtatgaagagcgagatcgacacgccgccggacaactggctggtattcgacgagcgctacaagaccccgtcgattgaaccggcagccatggaaccggacaacggcaacggctggtacgacccgaaaaccaaaaccctgcacttcgtggtcgccacccagtgcccgctggaggcagcgaccgaaactgcgaagatgatctcgccgtcgcgtttcggcctcgacaacctcaacatgcatccgggttacaccgtcggttacggttccaaagaccacaacatcttcgtttactacgcggccctcgccgcgttgtacggcgccggtgtgccagtacgcttggccaacgaccgctacgagcagttccaaagcgggatcaagcgtcacccgttcgacatccgctaccagttggccgtggacaagaacgactacagcttcaagattttccgcgctgaaatgagcgtcgacggtggtggccggatcaactacagcccctcggtagcggcggttggcgccactgcggcacagtcgatctactacatgccgcagaacgatctgcaggtcaccgcctaccactcgcgtgctgtcgaggccggttcgatgcgcggttacggcaccctgcagagcatggcggcgaccgaaatgatggtcgacgaaattgctgatcgactgggcgtcgatgccatcgacctgcgtcgcaagaacgccctgcgttcgggcatgaaaaacacccagggcgcgatccccgccggtgctttgcgcctgcatgaaattctcgacaaggcctcggtgcacgaagtctggaaaaaccgcgacgcgatcaagaaacagcgtgaagtcgcagacccggacaactggtacggcgtcggttttgccatttgccagaaagacttcggcaccggttctgaagcgccgatggccagcatcgaattcaccgctgacggtcgcatcaccttgcgccacatcggtatcgaaatcggcaccggcatgtccacctcgcaagcgctggtcgtggccgatttcctcggcagcccggcgcacgaagtgaagaccggtgaaaccgaatggaaggaaatgcagctgatcaccagcggcaacccttacatcatgagtcagactgagcaggataacctgctgcgcaacccgcgctgggtcggcaagctggcctcggcctcgtcggcgaccaactcggcgtactacttcagccatgccacccgtgaagcggcgcgcgtgctgttcaacaatggtttgtggccggcggcaatggagatctggcgtcaggggccttatggcggtcaagccaacccttacgtcgtgcgtcgcgaagatgcgcactgggttgacggcaaactcacggccaacggcatgcagcccctgagcttcgaagagctggccaaacgcgctcacgagcgtggtctggtgaccggcgccaccgttcacgcgttcaaccgctggagctgggccgaggccgaatacagcatcgacggcgtgcgcgagcgtctgccgctcgatggtctggcggtgaagtacggcgacggtgcacctaacgcgaaaaaagcgctgatgaacactgccggtttccacttgctggatcgccagaacatcaattatccggtcgtgcaactgaacaacgctgcggtgacttactacagcccggtcgccacgttggtcgagttgaaggtcaacaagggttcggcagaagtcgaagtgctcaaccaccattcgtgggtcgagtgcggtcgtgtgctggtcgaagaactggtcaaggggcagatggaaggcggtatcgccatgggcatcggtcacgcgttgatggaagaaatgccgctgtatgaaggtgggccgggggagggtgactggaacttcaaccgttaccgtctgccgatggcgcgccacgttgctgtgtggaaacagacgtcggaaattctcccggcgctgtcgccaagcgatccgtccaaaggcatcgccgaagtggtgatgatcccgattgtcggcgccatcggtaacgccgtggcgcatgccatcggtaaacgtgttcgcgatctgccaatcactgctgcgcgcatcaaggaggccctcaatggctaaccgtccgcttcaactgaccctcaatggtcaatccgtcggcccggtggacatccctgatgacctgccgatgatcgactatctgcacgaatacaaaaacctcaccggttcgcgtctgggctgcggccagggcatctgccacgcctgcgtagtgatcgtcgacaatcccgacggcaccagtgaagaggtgcgcacctgcattaccggcgcgcactacttcgaaggcaagaaagtccgcaccatcgagagccacgccaagcgtgacgaagacggtcaggtgactgagctgaacccgatccagcagcgcttcgtcgatgagttcgctttccagtgcagctactgcgcaccgggcttcgtcaacgccgcgaccgtgctggttgagaagctgcagcgccagccgattgtcaaaagccagctggaacaagtcatcgaggacagcctcggccatcacgtctgccgttgcaccgggtacgtgcgttactacaacgctacccgcaacgtgctgaccgatctcggcctggtcaaggagggttaagcatgaagcttttactgacccgcctgaccctggcggtcggcctcgctgcgccggtgttgtttgctcacgccgatgatcaggtcaagcgtggcgagtatctcgcacgcgctgctgactgcatggcttgccacacggcagcgggtggcgcgccgtttgccggcggtctgccgatcgtctcgccgttcggcacgatctacggcaccaacatcaccccgagcaaagagcacggcatcggtttgtataacgatgacgagttcttcgcggcgcttaccgaaggcaagcgtcgcgacggtgcgaacctgtatccggcgatgccgtacacctcgtatcacctgatgccgcgcgcggattcggatgcgatccatgcgtatctgaaaaccatcgagccgatcgagcgcgcagcgccggtcaccagtctgagttttccgttcaacgtgcgtccgggtctgatcggctggaacatgatgtacggcaaagacctgaaactggagtcggccgaaggcaaaagtgaagcgtggaaacgcggccaatatatggtcgaagtgctcggtcactgcggcgaatgccacaccccgcgcggcctgccgggtgcgatgcagctggataaacgcctcaccggcggaatccttaatggttatctcgcgccaagcctgctggctactgatctggccgctcgcggctggaacgagcaggatctgagcacgttcctcaagcacggcatgagcgcgcaggggacgatgttcaacgagatgttcccggtgttccacaacagcactcagggcctgagcgatccggatcttgcggcaatggcgacgttcctgctcggcgacaaaccgccggcagccaaaacgcttgtcgaagtgccggtggaaaaactcagtccgagcgcccagcgcggccagcaggaatacctgaatgtctgcgccggttgccatgcggtcggtggtgaaggcaaaccgcacatcgcggtggccatgcgcggcaacacaacgttgcgcctggaagatccacgcaacctgttgcgcgtgatcgaagatggtatcggcgagcagaagttttccggtttcgagcacatgcaaccgatgccgggttttgccggcaagctcagtcctgaacagctgaccgatctgctcaactacctgcgtcaagggtggggcggccagtctgccgagctggcagtgagcgaggtgcagaagctgcaagccgacgcaccgtccatcgagcacaaggcccactgacatgcagcatctcgatctacaagtggtgcgccgcgcgctggagtggtcggtggcggggcagcgtatctggctctgcaccgtgctgacgacttacggctcggcaccacgcgcgccgggttcgctgctggcggtgaacgaaggcgggcagtggatcggctcgctgtcgggtggctgtgtcgaggaagactttctcgagcgcgtcgccgaaggtgcgtttgtcgatgcggtcaacgttgtgcgttacggcgagggtgacgatccgcgttcgcgggtcagcctgccgtgtggcggcattctcgatgtgctggtagagaaatttgacgccgactgtgatgtgcaggcgcatctgcgtgagttggagtcggcgctgctcggtcagcgtcgcttgattcgcgaggtcgatctggccagcggtgcgcgcagtctgttcgcagatcgcgagcagggtgcgcgtatcgagcgtgagattgatcgggtgcggattcgtgttggcgcggcgcagcgcttgttgctcgccggttattccagcgtggcgcaggcgtgtgccgagttcgccgtgggtctcgggtttgaagtgattctctgcgatccgcgtgatgaagtgcttgaaggcgtggtgctaaacggcgtggagattcgtcggcaattgccttcggtgtttatcgccgatggtggctgccaccgcgatacggcggtcgtcgcgttgacccacgatccgcgcatcgacgatctggcgatgatggaagcggtgcgcaccgaagcgttctacattggcgtaatgggatcgctgcagacctcgcagaaacgctttgagcgactgcgccggatcggtgggctgggcgagtctgagttggcgcggatccatgcgccgatcgggcttaacctcggcagcaagacgccggcggaaattgctctggcggtgctggctgatatcctgcggatccgtagcgggattgctcgggatcagctctgaaaccgttcagtgttgaataaaaagggccgctgttcagcggcccttttttacatcccgaatttgtcgcgcaacccgtaataccaggcacccagcgccgcaaacggtgttcgcagcaattggccgccggggaacgggtagtggggcagatcggcaaacgcatcaaagcgctcggcctgaccgcgtaacgcctcagccagaaccttacctgccaggtgtgtgtacgtcacgccatggccgctgcagccctgcgagtaatagatgttgtcacccaagcgcccgacctgaggtaagcgtgagagggtcagcaggaaatttccggtccaggcgtaatcaatcttcacatccttgagctgcggaaatgccttgagcatcttcgggcggatgatcgcctcaatgttcgccggatcccgcgcgccataaacaacgccgccgccgaagatcagacgtttgtcgccagtcaggcggtaatagtcgagcaggtagttgcagtcttcgacgcagtaatcctgcggcagcaatgctttcgccagctcgtcacccagtggctcggtagtgatcacctgagtgccgcacggcatcgatttggccgccagttccggcaccagattaccgaggtaagcgttgccggcgacaatgatgaacttggccctgaccttgccttgcggcgtatgcaccaccgggttggcgccacgctcaatgcgcacggcaggcgattgctcatagatcgtgccgccgagcgactcgaccgccgctgcttcgccgagggcaaggttcagcggatgaatatggccgccgctcatatcgagcatgccgccgacgtactgatcacacgcgaccacttcgcggatgcggcgttgatcgagcagttccagttgcgtatgaccgaagcgctcccaaagacgcttctgcgattccaggtgatccatctgcttggcggtaatggctgcgaatacgccgccgtccttcaggtcgcactgaatgttgtacttggccacgcgctcgcgaatgatccggccaccctcgaaagccatctgcccgagcaaatgcgcctgcttcggcccaacggtgcgttcgatcacatcgatgtcacggctataactgttaacgatctgcccgccattacgtccagaggcgccgaaaccgaccttggccgcttccagtaccgtcacgcgaaaaccgttctccagcagaaacagggcagacgacaatccggtatacccggcgccgatcacacagacgtccgtctccacatcatcctgcaaggcagggcggggcggtacggtattggccgacgcagcgtaataggactctgggtaaggggtgttcgccatccggcagcctctgtttaatatattttacgagtgcaccgatcctacctgagttgaaaaacctctgccagccaccggaaaatcttcgtcagcggcccgaaattaaatattttgcatattcatagggttaggtgaaaaaaaggtgttgacacccctcgggaattccgtagaatgccgcctcacagcaggcacgtagctcagttggttagagcaccaccttgacatggtgggggtcgttggttcgagtccaatcgcgcctaccaaacaaaatccgctctgctgggcggtctagaagggctcaccgaaaggtgggcccttttttgttgtctgcgatttgcaaaacttttgcaaaacccccacctcagaacgccagttcggcgctcacctaaacatagtcgatagccttgtcgccgtgtccctcctggtagtgcttagtcaaccacgggtcactgtggccggcttcgcaccagacgccgtacttcgtgatcagctgctcggcgtcgggcagggcgaagagatccagctgaccggtgccgggctgctgatcaccctcgatcgcgttcattgcccagtccagcgccggcccggccagttcctcggtgcggacgctgaccatgcggttcatggctctttctatggagcaaaacaaagatagtgtttataagatgatttctgaggagctcgctgacatcgttttgtgaagactccactggcttttctagagcacactggcatgattcgtagaagtttgacatttgtgttcggcccggcatgggctagaaggagttgcaaatgattgagttaggtaggttgttaccaataactgtagttgcagcaataattttatttttcacaaaagaattttttgagtttttcaaaaaaagagctgaaaaaaagaggaaattgtccgcctataaggttctgatagccgaagaaatggcgaaaaattctttctcgatttttggattgcgccggatcgttgagcgactgcaagacaatagctgggtgcatgaagtgataagaggctctaacggtgcctgccacctcaagtcttctaggggtgaagaaaaagtaaaaggcatagtactaccgtttcactcatcaatttttgataagcatattgtcgatctagctgtaatcgacaaacaatttttcgcgcagctcagggatacatatcaagcgattgcagatgccaaggtatctcgatctacgatgcttgagatgtgcgaagacccaaatttggagttttttttaggatcctatctgcaaggggtcgtaacagtctttgatgcagctgagacgcaaataaaaacaacattcgagacctgtacaggaaaggttctcgatgcgcacaaacatacctctttcgtctaataagcagcgtctccatttcataggtgtcgcttatggtcaagcagtagtggcgtggtagttcggatcaacgatttcgtcatccggttctggtggatcttccacgagcgacttcattcctgcatcctcaatcagtctcgacaccttttcggtaacaacgataggtgtcgtgacacagtgcagcatcttggcctgggtttcgaagtccgcggcgatcaggtttatcaggagccgctggtgaatggcctgctgattgttgatgccgtgggcggccattaaccgcttgaggtcaggcttgaataccccggccacctcaaccgtaaactcctcgacgcccaatgccgcgtcctttgctgcagccttctcgcttcctgcgctgcttcttggcttcctccgccagttccttttcctcggccatggcctacctcttcaattccgctgactggcaagtccagccaggtctgtcgtttgcattgttgagtgcgaaaacgtctcacgttgcgaccttcacctgatgccaggcgccggtggcgtataacagcttccgctgctttgccttcatccatcgatatctcatccggaatggcgatccatcctgacgccaccagatggttcgggttcgcgctgttgcgcagctccgggtagtaatgctcaatggcgtccgtcaagcgctcgaccttgtagattccctcgtgcgagatctcgatcgacttgatgtactcggcgccgcactcgtcgcgacacatggcgccgatgtagatcgtccagcgataggagaaatcgaatatcgcgttggcgatcgccagactgcggatctgcttgcagctcttccggttcgccatgatctgattgccgctggggtcgctgttcaccaccgcgacgtggttggtgcgcaacagcgcccggcaactgcgttcggcccgggcgaaaccgttgttgggtttgcgtttcgatttcataccgagtccgccattttgcgcagagccttgcgatcggctgccgatatcggtttcgggcgccgtttgaggaccgtttcagggtctattttcttcgagcggggtggtggcagcggattgcgcggtgggcttttcagttgatcaatccgcccaccgggggccagatactgggcgattcgctcagcgatcgactcggcgtccggccggtgctgctcctgtcgtcgtgatgctcgggcattcgttgtctttcttgtaatggaattcgcagtactgtactccttgggtgcatcgctcgatttctacaattccaatgttctcaagttccagcgccgtgccaacgggctgcatctctttcgccccacttggcttccagtcgtgcaggagcgatatgctccgtgccgctaagaatggcatgccttgcttgattgggatttctgatgcacaggcaatggcgctggagaaataaaacaacatgcaagcacaagggcgaatctcactgtgagtcgctcttaatcgacgtcagggcagttgaagccccagttgttgattctcatgtctttgaccttttcgccggtcgtgctgacgaccagacattggttgtttcttttatagttgaactcgcagtattgaacgccttccgtgcatcgctgcacttcgctgatccccatatttctaagtgttttcattaggccgtcgggatccatttcatccgttaagtttggttcccagccctgcttgatcagcgcttttcgtgcgctcagaaatggcattcccttgttaatgggcagctcagttgcgttggcgaagaaacttatgcaagcgagaaaaatacaggtgacagcgtagggtttcattttgtcgtaccgccaaagctcttgtagttggttacaacttcgtcatagggcgtatagggttggccggaaggatgtccacccaatggacgattagcctggccgggacctaatggtaaggcttcccatcgtcccgatgccttgtgaatcgcatcttgaatatcgccatttacgatcggatcaatagcgcgcactttgcgtagaatttcgattgccgttaaatcctgtgtttttggcgagaagtcggataaccccattgccgtaatgcagttgtctctccaggacgctatcgtgatttgatacctgccagacgccgtggtcttgcccccgaagccggcgcctgggtgtgtcgactcatcagtaaaagcccagtttccacgcgcccacccgaagccatatttagcgtggtaatcaccaccttcggcttttgcaagggtatccagaaaagccttcacgttcttgttcttcaaatactcttcattttccgcccgtcttttctcttgcttgactgacagcaacatcgttttcgcggtggtgtctttaatgggggtcaccgctcttgtgagtctgggcgacatttttttgccattggggctgatcacgtctgtcacgttgatgctcactcaaaaaatagttgatttgcgggttcggcgataactcagtcttctaaaaagagcgtgatggtttccgccaggtgcgagctgacaacgtgtgtatagccattcttgtcgctgatgccgtgttcgatgctgccatcggcgcgttggaaggcgtagacatgatctggcagggggtcgccggagtcctcatcgatcagttgaaacttgtcgctgaagtgcacaggcattggcatcaaaccactaaacggtgctgtgaccacggtgtcaccgataatcactgtgccggatcctccaatcaccacattgccatgggcgccagtgctgtctttagttgcagcattcagcccgttgatgaataccgtcgcacttacaccgccagtaatggggctgccgcacgctgatttgtcggtcactcgagcagcagccaagccatcgaagtttacattgggtgaaccactggcaatcggattcgtgccatgtcccggcagggggcagttggtgggatctgttacgcgagctgcgggtttgccactcatgggaaaatccttttcaaggggtcaggcgggtgctgccaggatgtcgctgatttcgacgatgcgagctatccgtggcgtctttatgaaatgtctgggcggtgcgggagtcggcgtggagttgggcgggcgctggtggggaggagcctgtccataggtttggagtgcatcgaattgaaccgtccatgtaactttcgtacgcagatgatcctactatttcgaagaatggttaacaattgttacatctttctggttgactgattttcggcgattttttttcgcggagtttctccgcgctctgattggtttgggtccttgctgatttgcgtgcgaatgatcaggcagggtggatgtggctgtcgctactcctggagttgtgctttgtggcggccaatgagtaaccgtctgtcgccatcgtcctttgaaataatgtggagatttaatgacttacgatgatttttaaccgaccggttatcaaaaataagttgttaggtgcaggatgattcagtaagatccgccccgcgttcaccaccacggtttatgcatttttaaatcccaagcttccatcagctgcttgggattttttttgcctgcgatttgcctctaccggctgaatttctcgtttcgatctctcctgaatgcctggtgacacccgacaggcaaatccttgttttttcaactactactgactggccgattttcaactctttctgatgagggtgtatcgatgctggttcattggtttcttgcagctgtccatctgctggcatttgccttgggtttttgggccgtactgacgcgagggacggcgttcagtcgcttggcggcggggacgggagaggcggggcgggttctgctggccgacaatttctgggggatctgcgcactgatcttgttgatcaccggcgggatgcgtgccttcggcggatatgaaaaaggcactgactattatcttcatcaaccgctgtttcatctgaagatgacgctgttcgttctgattctgctgatagagctggcgccgatgatcacgctgatcaaatggcggatcgccaaggcgcggagtgcggagctcgataccgggcgagcaaagctgttcgcacgcatcagtcacgtcgaagcgctcttactggtgctaatgatggttgcagccactggcatggcgcgcggtgtggtgttcggataggaaggcgaattccctttgctctatcggaaatgtccgacagccagccttgagaatgctcggtagtatcgatcagcagaagggacgggagggtaacgcggcgggtgcatgtgtcaggcgccgtgcccaaggagcttgggaagcgggtggcaaaacggcgcgtgaatctttagccagtcattgcgcgcaagcaaacgaactggctactgactgcagtgcgactcagggagtctgtggcttgtccggggcggtcaggccagcctgaatacgctggtagatttcttcacgatgcactgcaacgtttttcggcgcgttgatgccgatgcgaacctgttggccgcttacgcccagaatggtgatggtgatgtcatcaccgatgtttatgctttcaccgactttgcgggtgagtatcagcatggtcttctccttgattgctttgtagggcacctgattcagacagtgcagaggtcggtggtacgtatagattagtgcgaagtctcacggtttgggtgcctctttctgacgcgcagatgcggcattaattcccagggcgtaactatacagaggctgcaatcatcaatctcgttgttttgtgcccattttgcggggctcgcgaagtatttatgaatgttaagatcgccgctttgagaattccgagggaagcgttgtgcgcaaattggtttgggtagtcgcggcactggtattggcaggatgtggtgaaggcaagagtgtggacgagcaaaagtcgccaacggtggccgcgacagctcctgtcgcagcatctgttgcgcagtgggatcttgaagtgcgtggcgaaacgcctcaggcggtcagtgatctgagtggctggttgatcgaacacgctttcgtgccgacagttgtcagggatggtagcggcaaaacgcgcattctgattggtccgttcaattcccaggccgaagctgaagcccgaaaagtgcaggtggatgcggcgttggtgaaagccaaaaaacagaatattgaatcggtcatcatcgagcatccgatcacgccgtaacacgctccattcggcggagctgcctaaaggtcatcaagcgcgattcgttccttttgaatcgccgaagatatccagaaggagctccccatggcctccgccaatccctacaagttgttcgatgtcactttgcagcgtaaaacccgattgagtccgcacatgatgcgcctcactctggtgggcgcacccgtttgcgaaatggccacgtgggcgccggatcaacgggtaaagctgtttttccctgccgccgacggttcacagtcaaagcttgcccaggacgaggggtggtacgcgcgcttcaagtcaatgctggtcgatcgacgccccgcgatgcgcacctacaccattcgccacctgcgagctgaacagggcgaagtggatatcgattttgttctgcacggtgaaaccggtccggcatcgcgttgggccttgcgcgcgcagccgggggactcaatgcagattcttgcccctgacaaacatttttcagcgcagcaggccggtgggttcgaatggaagcctccgcgagcgctaaagcaattgctactcgtcgccgattccacggcgttgccggccgccatgggcattctcgacgaaatggcggtcctcgccgagcccccgcaaacccaagcgttcttcgaagtcgacagtgcgcaagacatgctcgccgtgcctgactggcctggattatcggtgcaatggttgattcgtgatgaggccaatgcagaggtcgccggtgcgctgatggtcgatgcggtgcggcaagcgaccttgcccgtgcatacctcttcagaggggcaggccgtgaagcttgcggatgtcgatattgataaagacattctctgggaagttgccgacgccacaaccggaggtttctacggctggattgcaggagaaagtgcggcggtcatgagtctgcgcaaatacctgatcaaagagtgcggcatcccgcgcgaagcgctcaatctgatgggttactggcgctacaacaaatctggcagctaagcatgaaaaagggcctcgaacatcacgttcgaagcccttttgtattgcgtgagggattaaccgcaggctttcagattgactggcccgacaaattcattgccgcgccccatcacacacgccacgctctgattacgctggcgttcccagtcctgcacgggataggtcttgtcccacgcctcgtacaattgacgatcctgtttcgacaggcgcaggccatattgcttgctcatgtagaaataggtgcgggcgatcatgccgcgaatcgaagggcgcggcatgaccttctttgccttgaagtcgacctgagtcagacacgagccgtactgaccggattgcaccggtagccagccgtaactgaagttgctgcggtcgccattgacctcgccgatgctcggcaccaggttgtgcaggtcggcctcggctttctggtaggacgggtcatagcgtgtgcagttcttgcgaccgccttcctgccagcattgacgctgatggccaaactgccacgccggcacgatgtgctcccactcgatgcgcgaagcgcgtttggcgtttttgcgcggtatataaccgcaagccttcaaatcaactttgttgccggtgtatttgcatccgcagtaaaactcggtggactgcggcgcgtacagcttccaggcaaccttcttggcttcggtgaatgtgcggggtgcgccggcctgagcccccatggcgacgaacaacaacagtaaagcgaaaaagcggacactcattgaatcaatcttccttcggcacaacccaaaaaatctgcacgccgccatcgtctcggtaggcgagggtgacgttgtcgttctcgtcgatttcctcgagcaggcgctcccactcatccatcggctcatccggcaaacggaagatcagcgcggctttggctttttgtgcggtgggggagttgatgattttctgaacgcgcagacccatgcgttcgtaagcatcaggagcatcaggagaggtggccacgaggttatccttattaagctgtacgtgcatacagtatttaactgtaagcaatttcgcaactgcttaaaattcaagaaaatcctctgacagcggttttcggattttggtgtaggtcgtgtcgacttttttgtgggaaaaatgcagaagggttgtaagcagcccaccactcgccagacaggagagtggtgaaccaagtgcccgatcgagaatcgaccgggcgaaggtcaatcagtattcccagaacatccgttgcagttccttgctgtcattggttttggtcaatgcgaccatcgccaggatgcgggctttctgcgggttcaggtcgtgcgcgacaacccagtcgtatttgtcgtctggctgctcggcgttgcgcagaacgaagccgccagcgttgacgtgagacgaacgaatgatttgcacgccatccttgcgcagcgcttgcagggtcggaactacgcgagaggatacggagccgttgccggtaccggcgtggatgatcgccttggcgccggactgcgcgagagccttgtaggcggtatcgctcacgttgccgtaggaataagcgatttctacgtcaggaagactcttgatgtttttgatgtcgaattccgaatccatggtgtgacgcttggctggcaagcggaaccaataggatttgccttcgaccaccatgcccaacggaccccaggcgctcttgaaggcctcggttttgatgttgatcattttgctgacgtcgcgaccggactggatttcatcgttcatggtcaccagtacgcctttgccgcgtgcatctttactgctggcgacagcgacggcgttgtacaggttgagcatgccatctgccgacatggcagtgcctggacgcatcgagccaacgacgatgatcggcttgtcagtcttctcgaccagattgaggaagtaggcggtttcttccagggtgtcggtaccgtgggtgatgacgatgccgtcgacgtctttgctgtcagccagttccgcaacacggcggcccaattgcagcaggttgtcgttggtgatgctttccgaagcaatctgcatgacctgttcgccgcgcacattggccagtttgttcagctcgggaatgccggcaatcaattgttcgatgccaactttggcggcctggtaggtggcgctgttggcagcactcgcgccggcaccggcaatggtgccgccagtggcaagtaccaccacgttagcgagttttgtctgggtttcgacttctttcgcctgaagggcggtaggcaaaagcaggagaagggccaaagcgcccggaaccaaagtgttaaaagcagatttcattatttttctctctagtagtgagacggtgctgatgcaggttcatctagatgcgccccgggctgatctgaatgcctggagtgctatgggaagagcaggatctgtaccagccgtactttgctttagagaaatgtttaacctgatgatttaaatcaagtttttatgatttggaaaagagcagaggaaatcgcctatccgggtttccgaacaatggaagctttcgcgttcggttcaccgaaaaggactaccgatcctgtcgaacgaatctgcttgccggattcgaatgttctgctaaagaaagccccgcgctggccgatggtggttcaaggaaactaaaatgtagggagtccacatgtcactgacgattggtttggcaaaccccggcgccgtcaccatcggcggcaaaaccgcggcaaccatcaatgccttgagcgaggcgcagacagatgcgtccgctgaggcattgggcactgagaaggaaccaggcaatcaggtccgaaccggtggcgccgcgccagaagacagcaaggctgaaagtagcgataacctgagcgttaccgtcaaaatgctgctgaagcgaatgcaggaattacagaagcagcttcaggaacagcagcagcgtctggcggcggcgcaggctcagagttatccgacgccggaggcgaagtcgcaggcggtgatgtccattcaggggcagattgcgcaaaccagtggcgagatgatggaagtcgcgggagcactgctcaaggaaatgaccaaggattccaccagcggtaatctggtcagcaccacggcataaacagcgaaggggcgactcggcagattcgccctacaataaatgacgatttctgattgttgacaaatgtcggcgagattcgcatagtccggtctacgcaaacgtttgcgcggctttcccgatgcactgtctctcggctgaaagcgacgtagcttacgccagcgcaagcgttgctcacaataatcataagatcggagtgaacccatgaagctgccatttgctggacgtcttctcgctgtcgctatgctggccgccgccgctgccacgctccctgtctcttcggcgttcgccgaatcccctgaaaagcccaaggtcgcgctggtcatgaagtccctggccaacgaattcttcctgaccatggaagatggggccaaggcttatcaaaaagagcattccgccgatttcgatctgatctccaacgggatcaaggacgagacggatactgctggccaaacgcggatcgtcgagcaaatgatcctggcgaaggtcaatgccctggttattgcgccatctgactccaaagccatggtgccggtgatcaagaaggccgtggatgccggtattaccgtgatcaacatcgacaaccagctcgatccgcaaatcgtcaaaagcaagaacatcagcgtgccattcgttggcccggataaccgtaaaggcgcacgtctggtcggtgagtatctggcgaaacagctcaaggccggtgatcaggtcggcatcatcgaaggcgtgtcgacgacgaccaatgcccagcagcgtaccgctggcttcaaggacgcgatggacgcggcgcagatcaaggtcgtttccctgcagtccggtgattgggaaatcgacaaaggcaacaaggttgccgcttcgatcctcagcgaatacccggacgtcaaggcgctgctggccggtaacgacagcatggccgtcggcgccgtctccgctgtacgtgccgccggcaaggcgggtcaggtacaggttgtcggttacgacaatatcaacgccatcaagccaatgctcaaagacggtcgcgtgctcgcgactgccgatcagttcgccgccaaacaggctgttttcggtatcgaaactgcgctgaaaatcatcaagggcgagaaggtcgacagcggaaccaacggcgtgatcgaaacaccggttgaactggtcaccaagtaagacttctggcgacacaacgacgctcgcccgtccgggcgagcgtatggagagttttttatgtcagtttccgccccgaacgctgtcctctcggtcagcggtatcggtaagacctatgcgcaaccggtgctcaccggcatcgatttgacgctgatgcgcggtgaagtgctggcgctgaccggcgagaatggcgccggcaaaagcaccctgtcgaagatcattggtggcctggtcacgccgaccaccggccagatgcaattccagggcaaggactatcgccctggcagtcgcacccaggctgaagacctcggcgtgcgcatggtcatgcaagagctcaacctgttaccgacgctgtcggtggcggagaacctgtttctcgataatctgccaagcaacggtggctggatcagtcgcaggcaattgcgcaaagcggcggtcgaagccatggcgcaagtcggtcttgacgcgatcgatcccgatactctggtcggcgagttgggaatcggccatcagcagatggtcgaaatcgcccgcaatctgatcggtgattgccatgtactgattctcgatgaaccgaccgcgatgttgacagcgcgcgaagtcgaaatgctcttcgagcagatcactcgtctacaggcgcgcggcgtttccatcatttacatctcccaccgtctcgaagaactggcgcgcgtggcccagcgcattgccgtgctacgtgacggtaacctggtgtgcgtcgagccgatggccaactacaacagcgagcagttggtgacgctgatggtcggccgcgagctgggcgaacacattgacatggggccgcgcaagattggcgctccggcattgacggtcaaaggcctgagccgttcggacaaagtgcgcgatgtctctttcgaggtgcgcgcgggcgagatcttcgggatttccggactgatcggggcagggcgcacagagttgttgcgcttgatctttggtgcagacaccgccgacagtggcaccatcgccctcggttcgccggcaaaagtggtcagtgtgcgttcgccggtcgatgcggtgcgcaatggcatcgcgctgatcactgaagaccgcaagggcgaaggcttgctgctcagtcaatcgatcagcgccaacatcgcactgggcaacatgccagaaatttccagtggcggtgtcgtcaacaacggcgacgaaatcgctttggcgcagcgtcagatcgacgccatgcgcattcgcagttcgagcccgacccaactggtttcagagttgtccggtggtaaccagcagaaggtggtgatcggccgttggctggaacgtgattgctccgtgctgctgttcgacgagcctacccgtggcatcgacgtgggcgccaagttcgacatttatgcactgctcggcgaattgactcgccagggcaaagcgctggtggtggtgtccagtgacctgcgtgaactgatgctgatctgtgaccggatcggcgtgttgtcggccgggcgcctgatcgacaccttcgagcgcgacagctggacccaggatgatttgcttgctgccgcgttcgccggctaccaaaaacgtgatgcgttgctcaacgaagcggcgcctagggatctcccatgaaaactgcatctcctgccggcaagcgtagtggcaacttctacggcctgggcacttatctgggcctggccggcgccttgttggcgatggttgcgctgttctcggtcttgagcagccactttctgtcctataacaccttcagtaccctggccaaccagattcccgacctgatggtgctggcggtcggcatgaccttcgtgctgatcattggtggcatcgatctgtctgtgggttcggttctggcgctggcggcctcgacggtcagcgtcgccatgcttggctggggctggagcgtattgccggcggcgttgctcggcatggcggtggcggcactggctggtaccgttaccggttcgatcaccgtggcatggcgaattccttcatttatcgtttccctcggcgtgctggaaatggcccgggggctggcgtaccagatgacgggatcgcgcacggcttacatcggtgattcatttgcctggctgtccaacccgattgcgtttggtatctcgccgtcgttcatcattgccttgctggtaattttcattgcccaggcggttttgacccgcaccgtgttcggtcgctacctgatcggcatcggcaccaatgaggaggcggtgcgtctggccgggatcaatccgaaaccttacaagattctggtattcagcctgatgggtttgctggccgggatcgctgcgctgtttcagatttcccgtcttgaggccgccgacccgaatgccggctcaggccttgaactgcaagtcatcgctgccgtggtgatcggcggaaccagcctgatgggcgggcgtggctcggtgatcagtacgttcttcggcgtgttgatcatttccgtgctggcggccggcctggcgcagattggtgcgaccgaaccgaccaagcgcatcatcaccggtgcggtcatcgtgatcgccgtggtgcttgatacttatcgcagtcaacgcgccagtcgacggggctgatatacaaatatggcaacgatcaaggatgtagcggcacttgcaggcatctcctacacgaccgtgtcgcatgtggttaacaacacgcggccggtcagtcaggaagtgcgcctgaaagtcgaggcggcgatcaagagtctcgactacgtgccgagtgcggtggcgcgctcgctgaaagccaagaccaccgcaaccatcggtttgctggtacccaacagtctcaacccgtacttcgccgaactggcccggggcatcgaggattattgcgagcgaaacggctattgcgtgatcctctgcaactccgacgacaacccggaaaaacagcgcagctatttacgcgtcctgctggaaaaacgcatcgacggtttgattgtcgcctctgccggcggcgatagcggtctggcgcaagggctggccggtgtgaagacgccgatggtcattgtcgaccgaggcctggaaggtgtagacgcggatctggtacgcatcgatcacgagtacggcgcgtatctcgccactcggcatttgctggagttgggccaccgcgatattgccactatcggcggtccggccagtaccagcgtggcgcaaatgcgtcaggccggatattgccgggcgctgcaagaggcgggcatcgaagtgcggcaggcgcgcatgctggaaagtgatttcaccagcaccggcggttacaacgcggcagcgcttctgctggaaagcaatccgccgagcgccatttttgccggtaacgacatgattggtatcggtgtgctgcgcgcggcggccgagcgcaatgtgcgggtgccaagtgagctgtcggtgatcggcttcgacgatatccagatgagccgttacgtgtatccggcactgaccacagtcggccagtcgatcctgcaattgggcgagatggcggccgaagtgctgctgcgaaggattgccacaccggatcggggcactgatcagcggatcgtgaccccgagtattgtcttgcgcgaatcgaccgcgccgttgtccggcgtgttcaccgaataccgctgaaaccgaattgacgagtagtgatgtatgccagcaaatgtagtggtaataggcagcctgaacatggatctggtcacccgcgcgccacggctgccgcggggcggtgaaacgctgatcggtcattccttcaccaccgtttccggtggcaagggcgccaatcaggcggtggcggctgcacgactgggcgcgcaggtcgccatggtcggctgcgtcggcaacgacgactatggtgtgcaattgcgtgacgcgttgctggccgagcaggtcgactgtcaggcggtgagtgctgtcgaagattccagtggcgtagcgctgatcgtggtcgatgacaacagtcagaacgccattgtgattgtcgcgggtgccaacggtgcaatgacgccggcagtgatcgaccggtttgatgcggtgttgcaagccgccgacgtggtgatttgccagctcgagatccctgatgcaactgtaggtcacgcactcaagcgcgcgcgcgcgctgggcaagaccgtgatcctcaatccggcgccggccagtcgaccgcttccagcagactggtttgccgcgatcgattatctgattcccaacgagagcgaagcggccgcgttgagtggcctgacggtcgactcgctgcaaacagcggaaaatgctgccagtcatctgatcgccttgggtgcgggcaaagtcatcatcacccttggtgctgaaggttcgctgttcgcgagtggcaagggctttgagcatttccccgcaccgaaggtaaaagctgtcgataccactgccgccggggacaccttcgtcggtggttttgcggctgcgctggctggtggcaaatccgaagccgaggccattcgctatgggcagatcgccgcggcactgtcggttactcgcgctggcgcgcaaccgtccattccaaccatgtccgacgtacaggcctttaaacccgcatgaaaaagactcctttgctcaacgtcgcgctgtcgcgactgatcgcatccttgggccatggcgacatgctcgtcatcggtgatgccggattgccggtgcctcccggtgtcgagttgatcgatctggcgctgacccaaggcgttcccgatttcgtcagcaccctgaaagtcttgctcagcgagatgcaagtggaaagccatgcactggccaaggagatctttgacaagcagccgacggcgctgaccacgctggacgcgctgaatgacgaaggcgaactgggtcgtcgcgacctgctcagtcatgagcaattcaaggttctcagccgccaggcgcgggcgattgtgcgtacaggcgaatgtcagccgtactgcaacatcgtgctcgtcgccggggttacgttctaactttcgatgtccacctgcacaaggaatgcgccatgcaacgctatgctcacaaactgcatcaattaatccggagtctgctgcttttgtccgtgataactgcgaccggcgctcaggcggcggaaaaaatcgacctgatcatcgataccgatccgggcgcggacgacgtggtcgccttgctgttcgctctggcctcacccgatgaattgaatattcgtgcactgaccacagtggccggcaacgtgcgtctcgacaagacatcgcgtaacgcgcgcctggctcgcgagtgggcagggcgcgaggacgttccggtctacgccggggcgccaaagccgctgatgcgtacgccaatctatgccgagaacatccatggcaaggaggggctgtcgggtgtcactgtgcatgagccgaaaaagggcctggcggaaggtaatgcggtcaactatctgatcgataccctgaaaaaagccaagccacacagcatcactatcgccatgctcggtccgcagaccaacctggcgctggcattgatccaggaacccgagattgttcagggcatcaaggaagtagtgatcatgggtggtgcgcacttcaatggtggcaacatcacccccgtggctgaattcaacctgtttgccgacccgcaagccgctgaagtggtgctcaagagtggcgtaaaactgacttatctgccactggacgtgacgcacaagatactcaccagtgacgcgcggctgaagcagattgccgcgctcaacaacaatgcgggcaaaatcgtcggcgacatcctcaacgagtacatcaagggcgatatggaacactacggtatttcgggcggcccggtgcatgatgcgaccgtcgtggcgtatttgctcaagccggagctgttcaccggtcgttcggtgaatgtcgtggtggatagccgtgaagggccgacgttcgggcaaaccattgttgactggtacgacggtctgaaagcaccgaagaatgcattttgggttgaaaatggcgacgcccagggcttcttcgatttgctcaccgagcgcctgaaacgcttgaagtaagcaatccgcccgcaggtgccagcctgcgggtttttacccccttgttgcgagttcgtgctcgacctgttcggtcgggtagcgctcgaaaatctgcttgatgaattgctgggccgcttctgtgcccagctctttaaccaatagatcgataccaatcagcgccagttcttcagtggttccagggctgtaagaactgtgtccgtctgcccatttggcgttgatggcggcgtcgatgctgatggtggtcatgagagcgctcgaaaagtcgaaaggtctgagtgccgagttaaccattttgtcgggcgtttggcactgcgacttaggcatgagcgcacggctatgcgacacttggtcttttccggctgatccaaggactgtgttgtgcagatcgatttgaatacccctgatggccttacgctcgacgcggtgcgtcagttgctggcctcggccagtgatgatgagcacacccagctgcgcgtgacgaagggcggtattgcttacatttcctcgggcgtgaccggtgggcaggacatcgatagtctgctgtttcgtcttgagacgtgggccaagggttcgggctacgtcggaaatgtcgcagccagcgatgaagtctgggtgatgcagattttcaatgcgctcaaggataactggcccaatccgccctttgactacatcgatgtctactgagcgccgttaatattcagtcacgattgatagatgaagagtcgagctacgctcaggcacactcggcgtttttctgatcgtggggcaggtgatggccttggccgtgaaaccaaacgccgcgatggcggtcgcacgatctcagcttaactttattgaatacaaggaggcttcatgcctttgaagttcgcgacactgggtgcacttatggccgcagccctgttggccggttgcagtacgagttccagcgagtcggcaaaggatccagtggcaaccgaatcgggtcacagccgctgtgaagcaacggcggcgcagttcgccattggcaagaaggcttcacctgagttgctggagcaggctcgcgccaaagccggtgcgcagaatgctcgtttcctcaagcctaacgatatgatcacgctggagtaccgctccgatcgccttaacctgaacaccgacaacaatctggtgatcactcgcgtcaactgcggctgatcgcagaacgcttaggttacaggcataaaaaaccccgtcacatggacggggtttttttagtgcgccgagaaattactctgggcgaacctgtgcagcttgcatacccttttggcctttctcagccacgaaggagacagtctggccttctttcaggcttttgaaaccgtcggattcgatagctttgaagtgtacgaacaggtcgtcaccgccaccttgaggagtgatgaagccgaagcctttttcatcgttgaaccacttaacggtgccggtttggcgattagacatggtgtatctccaagaaacatatatttttcagtactgtgctgctcaggccaactgggcacacccgggtatcatagtcgaaatgttcgctttggtagccccccggacgtgctgtttgccaatcagtcgtgttttctttactgccttttttggctgcaggccccggtttaaaaggcttcgagcgaaaagtaaagacaataaaaaaacctgtaaaacctgcataaatcgtctgaaaaggctcatttctggcgcttttttccagcctttagccgatcatcaaggcctttttcatcactttttagccggggtattcgccttgcatttggcgatttgacccaaggctttctgttgcagatcaggcgttgccttgttgtccatcagtgcctgaatgtcgctggctggataagacttgattgcgtccgcgccacaggcacagtgggatttcgctgcagcggcgccaatttgtggagtggccgcctgtgtgcactgggccatgtacttctcacgctcgcccttcggccaatcggcgtgagcgctcagcggcagcagtagaacaatgggggcgactacggcgaataaggtgttcagacgcatgcgaggatgctccttgtgggtcagtgtcttgttatctgagggctgaagggccgatcaagttcagcactctggcataaaaacggacgatttgccttctggtcaaacagaggcataagtgaccgctcatctgtgctagcatgccgggctcaagcgttctcaggctccggatgacactcagtcccggcagcagtcagcgtgcgaatattctgatttgaatcccagtcactctggttcggttttccggttggccgcaaggctcctgccgctgtaaggcaggcgttcgtcattgaatggcctggatcggatcttgtactggctcatcccaacccacgtgacctttggtaggggtcaccactaggagaggaggcgccatgccaactattactcttcccgacggcagtcaacgttcattcgatcatccggtttccgtagccgaggtcgccgcatccattggtgctggcctggccaaagccaccttggccggcaaggtcaatggccaactggtcgacgccagcgacatcatcagcagcgacgcgaccctgcaaatcattacgccaaaggatgaagaggggctggagatcattcgccactcttgcgctcacctggttggccatgcggtcaagcagctgtacccgaccgcgaaaatggtcatcgggccggtcatcgacgaaggcttctattacgacatcgccttcgagcgtcctttcactccggacgacatggctgcgatcgaacagcgcatgcagcagctgatcgaaaaagattacgacgtgatcaagaaagtcactccgcgcgccgaagtgatcgaagtgttcaaggcccgcggcgaagattacaagctgcgcctggtcgaggacatgccgaacgagcaggccatgggtctgtactatcacgaagaatacgtcgacatgtgccgcggtccgcacgtgccgaacacccgcttcctgaaatccttcaagctgaccaagctgtcgggcgcctactggcgtggtgacgccaagaacgagcagttgcagcgcgtttatggcaccgcctgggccgacaagaagcagctggcggcttacatccagcgcatcgaagaagctgaaaagcgcgatcaccgcaagatcggcaagcgtctgggcctgttccacacccaggaagaatccccgggcatggtgttctggcatccgaacggctggactctgtaccaggtgctcgagcagtacatgcgcaagatccagcgtgacaacggctatcttgagatcaaaacccctcaagtcgttgaccgcagcctgtgggagaaatccgggcactgggccaactacgccgacaacatgttcaccacgcagtcggaaaaccgcgactacgccatcaagccgatgaactgcccgtgccacgtgcaggtgttcaaccagggcttgaagagctaccgcgagttgccgatgcgtctggccgagttcggtgcctgccaccgtaacgagccgtcgggtgcgttgcacggcatcatgcgtgtgcgtgcgttcactcaggacgacgcccacatcttctgcaccgaagagcagatgcaggccgaatccgctgcatttatcaagctgaccatggacgtttatcgtgacttcggtttcaccgatgtcgagatgaaactgtccactcgtccggaaaaacgcgtcggttccgacgagctgtgggatcgcgctgaagctgcattggctgcagcccttgattctgcgggcctgccgtacgatctgcagccgggcgaaggtgcattctacggtccgaagatcgaattctcgctgaaagattgcctcggtcgcgtctggcagtgtggtaccttgcagctcgattttaacctgcctgtccgtttgggcgctgaatacgtctctgaagacaacagccgcaaacacccagtgatgttgcaccgtgcgatcctcggttccttcgagcgtttcgtcgggatcctgatcgagcactacgaaggtgcgttccctgcctggctcgcgccaacgcaggcggtgatcatgaatatcactgataaacaggcagattttgttgcagaagttgaaaaaactctcaacgaaagcggatttcgtgccaagtccgacttgagaaatgaaaagatcggctttaaaatccgcgagcatactttgctcaaggttccctatctcttggttatcggagataaggaagtcgagatgcagactgtcgctgtgcgtactcgtgaaggtgctgacctgggctcgatgcccgtcgcccagttcgctgagtttctcgcgcaagcggtttcccggcgtggtcgcccagattcggagtaattattattaagcgtgaaatgagacaagataaacgagctgcaccgaaagccccgatcaacgagaatatctcggcacgcgaggttcggttaattggcgctgatggcgagcagattggcatcgtctcgattgatgaagcgcttcgtattgctgaagaagcaaagcttgatctggtggaaatctccgcagacgcaatcccaccggtttgccgtgtgatggattacggcaaatcgatcttcgaaaagaagaagcaggttgccgcggcgaagaagaaccagaagcagattcaggtaaaagaaatcaagtttcgtccagggacggaggaaggggattaccaggtaaaactgcgcaacctggtacgtttcctgagtgatggggacagggccaaggtatccttgcgattccgcggccgtgagatggcccaccaggagctggggatggaactcctcaagcgggttgaagctgacctgctcgagtacggttcggtcgaacagcatcctaagatggaaggacgccagctgatcatggtcatcgccccgaaaaagaagaagtaatcaacagggcacggcaggccttctgattatgtttatcaactgaatgcggagtatccgaacatgccaaaaatgaaaaccaaaagtggtgctgctaagcggtttctgaaaactgctaacggtatcaagcacaagcacgctttcaagagccacatcctgactaaaatgtcgaccaagcgtaagcgtcaactgcgcggtagcagcttgctgcatccgtctgacgtggcaaaagtcgagcgcatgctgcgccttcgttaattttagtcaagaatagaggaagtaactcatggctcgtgtaaagcgtggcgtcattgcccgtaagcgtcacaaaaaaattctgaaacttgctaaaggctactacggcgcacgctcccgcgtattccgtgttgccaagcaagcggtaatcaaggcaggccaatacgcctaccgtgaccgtcgtcagaaaaaacgtcagttccgcgctctgtggatcgctcgtatcaacgctggtgctcgtgttaacggtctgtcctacagccgtttcatcgctggcctgaaaaaagcgtccatcgagatcgaccgtaaggttctggctgatctggcagtgaacgaaaaagcggtgtttgctgcgattgtcgagaaagctaaagccaccttggcttaagtacccccgacaatcacccggcctcacttccgtggggccaggtggtaaacgtcttaaataggggaagagccttcaagctcttcccctattttgtatctggagtctgtacatggaaaacctggatgcgctggtctctcaagcactagaggctgtgcaaagcgctgaagatatcaatgccctggagcaaatccgggttcaataccttggcaaaaaaggtgaattgactcaggtgatgaagaccctggggaatttgccggcagaagagcgtccgcaagtcggcgccctgatcaacgttgccaaggaacgtgtcacaggcgtactcaatgcgcgcatggccctgtttgaagaagccgaactggctgccaaactgtctgccgaatccattgacgtgacgttgccgggccgtggccagacctccggtggtctgcatccggtaacccggactctggaacgtgttgaacagttcttcacccgtatcggctacggcatcgctgaaggcccagaggtcgaagacgactatcacaactttgaagcgctcaacatcccaggccatcacccggcccggtcgatgcacgataccttctatttcaacgccaacatgctgttgcgcacccatacctcgccggtacaggtccgcaccatggaatcgaagcagccgccgatccgcattgtctgcccaggccgtgtgtaccgcagcgactccgatatcacccactcgccgatgttccaccaggtcgaaggcctgctggtcgatcgcgacatcaatttcgccgatctcaaaggcaccatcgaagagttcctgcgggtgttcttcgaaaaagaactggccgtacgtttccgtccttcgtactttccgttcaccgagccatccgctgaagtcgacatggaatgcgtgatgtgcagcggcaaaggctgccgcgtctgcaagcagactggctggctggaagtgatgggctgcggcatggttcacccgaacgtgttgcgcatgtccggcatcgatccggaagagttctccggttttgccttcggcatgggcgtcgagcgtctggccatgctccgttacggcgtgaacgacttgcgtctgttcttcgacaacgacttgcggttcctcgcgcaatttcgctagtcgtaacgaattcttaggagagcaggatgaaattcagtgaacaatggctgcgtggctgggttagcccgcaggtaaatcgcgacgagctggttgctcgtctgtcgatggccggtcttgaggtcgatagcgttacgccggccgccggtgtattcagtggcgtggtggtgggcgaggtgctgagcaccgagcaacatcctgatgccgacaagttgcgcgtgtgccaggtcagcaatggcgcggaaaccttccaggtcgtctgcggtgcgccaaacgtgcgtccgggcctgaagatcccgttcgcgatgatcggtgccgaactgccgggcgacttcaaaatcaagaaagccaagctgcgtggcgttgagtccaacggcatgctgtgctcgcaagccgagctgcaggttggcgaaggcaacgacggtctgatggaactgccggccgatgcgccggtgggcaaagatttccgcgtgtatctggatctggaagacgccagcatcgaagtcgacctgactccgaaccgtggcgactgcctgtccctggccggtctggcccgtgaagtcggtgcgctgtacgacgcgccggtcactcgtccggtggtcatgagcattcctgccgtgcacgacgaagtacgctcggtagaagtgttggcacctgcggcatgcccgcgctacctggggcgcgttatccgcaacgttgacctgtccaagcctacgccgctgtggatggttgaacgtctgcgtcgtgccgacgtgcgcagcatcgacgctgccgtcgacatcaccaactacgtgatgctggaactggggcagcctctgcacgctttcgatctcgccgaaatcaatggcggcatctgcgtgcgcatggcggaagagggcgagaagctggtgctgctcgacggtcaggaagtcagcctgcgtagcgatacgctggtgattgccgaccacactcgcgccctggcgattgccggtgtgatgggtggcgagcacagcggtgtttccgcgaccactcgcgatgtattcctggaaagtgcgttcttcgaccagattgctgtggcgggcaaggctcgttcgtacggcctgcacaccgacgcttcgcaccgctacgagcgtggtgttgactggcaactggcccgtgaagccatggagcgcgccactggcctgctgctggaaatcactggtggtgacgccggcccgatcatcgagaccgtgagcgagcagcacctgccgtcgatcgcaccgatcaccctgcgttcccagcgcattacccagatgctcggtatggaaatggattcagcccaagtcgagcgtttgctcggcggactgggtctgggtatcactgccgacggtgaaggtcagtggcgcgtagaagtaccaagccatcgcttcgacatcagcctggaagtcgatctgatcgaagagctggcccgtctgtacggctacaaccgtctgccggttcgttacccgcaagcgcgcctggcgccgcaagccaaggctgaagcgcgtagcgatctgccggaactgcgtcgtctgctggtcgcgcgtggttatcaggaagcgatcacttacagcttcatcgatccacgtcagttcgagctgttcaatccgggtgttgagccgctgttgctggccaatccgatctccaatgacatggcagccatgcgctcgtcgctgtggccgggtctggtcaaagcgctgcagcacaacctcaatcgccagcaggatcgcgtgcgtctgttcgaaagcggtctgcgcttcgtcggtcagctcgaaggcctgaagcaagagccgatgctgtccggtgtggtttgcggtagccgtctgccggaaggctgggcgcaaggtcgcgacaccgtcgacttcttcgacgtcaaagctgacgtggaagcggtgctgggctttgccggtgcactggattcattcaccttcgcaccgggcaaacacccagcgctgcatccgggtcaaaccgcgcgcatcgagcgagaagggcgtgaagtcggtttcatcggtgctatccacccggaattgtcgaaagctttgggtctggatcgtcccgtattcgttttcgagctggttctggctgaagtggcgctcggtaaaatgccgaaattccacgagttgtcgcgctttcctgaagtgcgtcgtgaccttgcactgatcgcgcacaaagacgttgcagcgtcggctgtactggacgtaatccgtgaaaatgcaggcgaatggctcacagatctcaggctgtttgacgtatatcagggtaaaggcattgatcctgatagaaaaagccttgcagttggcttgacctggcagcatccatcgcgcactcttaatgacgatgaggtgaattcgacgacgcaaaatatcctcacctcgctcgaacaaaggttgaacgccacgttaaggaagtgacgtatgggggctttgacgaaagctgagatggcggaacgtctgtatgaagagctgggcctgaacaagcgggaagccaaggaattggtagaactgtttttcgaggaaatcaggcacgctcttgaagacaacgagcaggtcaaattgtccggtttcggcaatttcgaccttcgggacaaacgccagcggcctggccgcaacccgaaaacgggggaagaaatcccgatcacggctcgccgtgtggtcacctttcgtccagggcagaagttgaaggcccgagttgaggcttatgctggaaccaagtcataacgacgaactccccgttatcccgggcaaacgctacttcaccatcggtgaagtcagcgagctgtgtgccgtaaagccacacgtgctgcgctactgggagcaggagtttcctcaactcaaccccgtcaaacgccgcggaaaccgccggtattatcagcgccaggacgtgctgatgatccggcagattcgcgcgctcctttacgaccagggtttcaccatcggcggcgcacgcctgcgcttgtccggcgatgaagccaaagatgacaccacccaatacaagcagatgatccggcagatgattgccgagttggaagacgtgctggtggtactcaagaaataaaaagctgcttttgaatacttccagttttcaaaagcttgcgctatattcttgagcgctcttcgaggtgaagagcgagttgcaagaccagtcggggcgtagcgcagtccggtagcgcactagcatggggtgctaggggtcgagtgttcgaatcactccgtcccgaccatataattcaatgacttaggccaatgttcgcagcattggcctttttcatgcgcgtgacatttgcgtgacttctccatttctcacgcttgcttcctcttcaaaattgtcagcaccggcccacgtgaatcggttgctgataccatgttcgcagcctcaatcagatgcccgagctcagcgcccgaatggtgactggtgatgctgccgttcttgtggcccagaagtgccttttggtcttcttcggccacacccgccgctcgaaggcgacggccaaacgtgtgtcgcgtcaaatgaaagacgttagccggtgtgccacctgcgtcaggctctttgccttttcaacgtaacggcgagcatggctgtcgagactattccaggcattaggaatatgcacgtgagttcgggaagcccgcgcaggtagtaggcgagaaacattccccagatcatggctaccacagcagccaatgcaagtgatcgagggttgcgcacgtttggtgaggctgccatcgcaagagcataaattttccaggctgaccatatcccaagcagcgagatgataaatgcgcctatacctcccagtagaactagagggggctctgggatgacgaaaaagagtggaatgaacaaagccacgatgccagctgcgaagaggagggtgattggcacaaacccgacaagtgctccgattgtcagcgcgactcgcaattttgtcaggttttccatttcctacctttagttctgcaccgttgtttacgcggacttaataccggcaacaagccattatttcaagcccaaaggggactatgggcaggccattatgatctctataacggtatgcatccggaatgcactttaggtgcgctgaccctcattgggccggagggcgaagtgatggtgttcgggcttggccccaagtgcgactacctgcagtgtctgggtgcaatgcgccttggtgagcagaagttgattgatgtgctgctgggtggcggggaagggtaggtgtgccgcacttaagtgcggcaccgatgagtcacttaagtttcgtcgctgcctggatgtaatcggcgtattttgacagtagtttcagctcagcctcgaggttcgtaggcgtcggcccggccgcttttctggctatcaactcaagagctgcagaaacagctaggactcttctgccttccgacttcgtcttgtagtaagccgcagactcaaaaatgcattctttgatggataggccgtctgaagttttttttgctccggttgtgacgggggcggcaggcttttttgtcgattcagtcatttaattggagccttttcatttatggtttccgttagatagaggcaaagtgacatcttttcaacccgtacgtttgggcatacaagagacaatttatgacaaccaagcaacccgactaggaggcatcgactccctctctatcgggccgctgtcagttgcctacgggctgaggtgcttgaagaggcactgaccaacaggttgaccataggctgcgcattcggcttggatctcggttaacccctgagcgaagcttccaatgcacagacccaaaagtgccgcaatgacgacataggcccacacgcgatcagttggcatcgactgacgtttcatccacgaatctgcgcatcttgctccgtaaaacagaaagtacagcgcaatcagcgcagcgacgccgattgccgagtaaaaacccagcgaaaagatactgaggggtttaagaaactccattgcacatctccttttttaagtgaggctcgattgaagtactctggcatcacgcccgccactcaactgcgtgtagtttctagcgctcgggtggcctgatcacaggacgcactccaatgcacaggcccgtgtctcccacgtcactccttgtagtgtctgagctatcggcctcgggatcgaaaacaccggtgccgggctgcaaagccagttcctggtcagcgccgatcgattcgcaatcgtcaacaccattgccggcggcgcaatctcggtgctgttcgcagtgcagggcggtcacggtttacagttcaccaacaatagcaacggcgtcaccatcgactcagagttcgcgcgggtggtgtcggggcaggtgaccaactttccccgatgacgtctacagatcacacaatgggaaagtgataaggaagttacgtgctacggaagctcattttgatgttggctatttcacagttgagtggctgcgcctggcttggcgcggttaccaatccgaacagctcatatgactgctatgacggtgttgatggtgaatacgacctttggatgtttctcggcccgcttgtgttcatcgacttaccatttaccttcgtagctgacaccatctcgctgccgttttgcgcgctttgacgccagtcccctagacatcgattcgacacttgagtcgttgcaggcgggcgctataggtcgccgttttgtccacgtcggggtgtgacctggcaggtgccaatccctacatcagcccagtttattgctcgggcttcgctgcttggaagctcgccgcttggcggcgggattcagatcacagcccgatgtgctctcacagagaggatcgggctgttaacgacaggctgttgtggcgctcgttgctcagtcgtaaatgccgtagttgaaatcgtcctcgtcgcagtcaacgacaatcttcgcggaaggcttttgcagttgatcccgcaggcagattcgtacagggtgggtggattatgcgctgcagaaatcagctgcaatgattcatgctttttttgaaagtttaaggatgattcgatgaaagccgctctgatcatttcggcatgcctctttgcatccggttgcgcccagattgttccggtcgttaatgaagccgaacagcaaaaatatgatcctgcctctactgctcgaatcagggtttattcaaaccccaatctccgggcttcctacacgccaggtaaatcttgtgaagagtacaaagcgaacgctgatgcagaggtcagccgaaaaaaaggtcaggtgaatctgctaggcatgtcgcccgggcagtatgaaaacgaagtcatcggaatgcgcccttcgtggcactccgcgcatttgtcttatagagagaaatactcggagcttgtcctgccagcgggcgtgccaacggtaatctcgataatctccttccaaggggtcatgtgtaatgcacctgcacgatcctttactcctcgagccggaaaagattacgaggcctatcttgcgtttcagacaaagcatgcagcgctcggtatctgccaagtggtcattcaagagttgagcgatcgtgaaactccggagcccgatgaggtggtcaaaactggcatctgtgtcccggtaggggaaagccgcttgggtaattggcggactgaaaacaagtaaatatgaatccctcttcgagttcgctaaccatgaacagcattccccacctgaacgatctcctgttctcgcacaactgtgtgatctcaatgaacatcgagatgcaggatttcaagtacgacctgtcgttaaccatgtcgtcctccaacgatccagaaacagccgctgtcacggtaaaattccatgacgtcagcgcactgcacctgaaaggcttcggcggtggactgactcaattcatggatttgagcgtgagccgaatcgacgatggtctcgacagaatcagatatgagctgagggatgttgaagaagaaaaaatctcgttctacttcttcagcttcagcgcaactgttcaaaaggtatgaacatgctgaatttaacaggatcctcgtgccaactgcaggcgcgcattcagcaacgattcacgcctcgccaccgacgcaatggcggtattgcgctgctcgttggctgggctgtcgggatgatggtctatcccggtcaatatctgctttatcccgctatatgcgggatcatcaccttgttcagcagcatggatagagtatcgaaacagcgacttttttagcacctttgctctttacccgaattcgctttgccatcaggagaaaaacaaatgaaacggatgttgttgatcgggctgttcgcagcattacttaccggttgtggcgatccaaaactggacgcaaccactgaagcatccttgcaggagtcctctaaaaaggttgctgaaaagctctctccagacgagaagaaacagttctcggcagacctgatgctgattgccttgagcaatcttagtctcggcaatacgtcgctggtcggcgtgcagcagagcaacagtttaagcctggatggaaagaccgctgccgacgtaaatacgatggcagcgaccattcgcgcagcgaccgagcagaagaaaaaacagcaggcgttattggaaatcaaggaactgaaatccaaggctgcttctgccgaaatcgcgaaaaacgagctggcgaagtttgccgtatcgaggtccaggcttctggagcagcaagctgacaagtactccaagatcgctcagccggttattgagttgactgtgcagaatggcacttcgcatccagtctcgcgcgcatacttcaagggcaccattgccagccctgaacgagcggttccatggtttgtcgacgctttcaattatgaaatcagtggtggtctggagtctggtgaaagtgcgacctggcaacttttgcccaacaaattcggtaagtggggcaagattgaagcgccggctggagccatttttaccgtcgaggtctaccggctggatggcccggacggcaaagcgctttttgatgccggcggcctaagtgagagcgaacaggcgcgactggatggcctgcaaaatcagtatggcccgacttgatcgcctgactcacaaaaaaaacccgcctcggcgggttttttctgtctgttgatccacataacccttcaggtagttttgcccgaggtcttttgcgcggcatcaatgcaaagcgagtaatacgtcttctgaaattcatcgaccaaaccctgtcgcatcttggcgtcgggttgctgcgggaattcataggcctttccgatcaaacttttgtacaaactgcctacgtattcactttcttttccggcgtcgtcggccatctccagcacggttgtacggggtacgccttcttgtctggcattcatgattgctctggccgagttttctactcgtttgcactcttccaaaagctcgttgggcagattggcgctgttagccgcaaggctggtgaacattagcgttgctgctacaaaaattcgtttgatcatgacgcgccatccctgatttagagcctgaactttaccattcatggctcagcgccaccatctgccgagtttgctcaagttaacggccagagagaattcattgcccggattttttcatatctccagaatcactcgaaccctcggcatccttctgcgtctcgtgcgcttcagccccggaattggagcccgaagcctcttctcctttcttgttcgctttttcttctttcgactccgaccctccctgattcactcccggaattgccgtcggcggcaccgaagaaccgctggttttttccacggcaagtgcaaacagcgggcagatcgaaatcaggccagccagcccgattacagccattttattgttcatgagattgttttccgagcaagggcatgtactgcattggaagaaccaaagagctgatcgtgcgaatcatcagaccggcggcatccccctatcggactatgcaggcgcgctccgccagacgaatagaaggcgccgccctcacccaatcatgacccccgccgagtcggcggcgcagttgtctgcggccatcgccgcgaagcgctttttgggggttactgcacaagggctttgaagcggcactgcagcttcgtgtacaaagcatcctcgaagaatccagcccacagtttcaaatgtcagatgttaaggaagacgtccatgccagtcgataaacagatcgccccgattctccagcaattcagcgagctgccagcacccgattacggccagctcgatgccgcgcaataccggcagtttttcgacaacatgcagccggtcattcccggtgaaccgatgagcgaggtgcgcaatctgcgcgttgccggcgcggtcggtgaactcgatgcgcgactgtaccgcccctcggaaaaacacgatttaccgctgttggtgtatttccacggtggcggtttcgtcgttggcaacctcgatacccacgacaatctttgccgctcgctggcgcgccagaccgaagcagtggtggtgtcggtggcttatcgcctggcaccggagcatccgttcccggcagcaccgctggactgctatcaggcgatatgctggctggttaagcacgcggccgagttgggtgtcgatggcagtcgtctcgccttggccggggacagcgcgggcggcaacatggcgctcgcggtcagtcaattggcggcacagcaccaaaagccgaagatcagctaccagtgcttgttctatccggtgaccgacgcacgtaacgacagtccatcctatgcggaatttgccgaagggtttttcctcacggcgaacatgatggactggttctggcagcaatatctgccaaaggccgggcagggcgatgatccgctggcctcgccgttacgcgccgcaagtctggcgcatatgcctccgactacgttgatcactgccgaattcgatccgctgcgcgatcagggcgaggcgtttgcccggcgcctgcgagaagctggcgtgagcgtccgtgaccagcgttgcgacggcatgattcatgggttcatcagcatggcgccggtggtcgagcgcgccgcgcaagtgctgtccgaggccgccgccgatttgcgtcgggcgctcatctgacacgctcgattcaggttgcagtcgacccggccatttccgccgaaatcgcgccgggttacaccatcagcgaggccggcggcccccgtcccaccgcgcactgctcggcgacccgcgccacgccccccggcgcgtgtcatttgccgcactcaaactggcaaaaagaaacccgtgcaggagcaaagctcgctcgctaaagcgttcgttccgccagaaaacattcctttttctgtaggacgtggttgatccgaagcgttaaagaacacgtgtcgttgatcggtcctgcggacacaaaaaaccgcgatcccctcaccagagaatcgcggcctaccaacacccaacccctactgctgcaaaaccgtcgcctggttggccgagccgaactgctgaatatttgccgtttgcgtcacgccactctgatcgacgttggcaatgttcccggtaccgccctgggtcacgtacgccacgttcatggtgtcggcctgtttgaccgtgatcatgttgtcgctgccatacaactgtgcggtatatgcctggttgcccgaaccggactgatcgaactctgcgctgttgcccgtgccgttcgatgagccctgcaccaggttggtggtcccgcgctgatcggagatcagaatgttgtcgctaccattctgatcaaagtacagctcgttatacgactcagcctgactgaccgtggtcttgttgcccgtgccagtctgatgcgtggtcatcacttggccgacgccatcctgagtgaagctggcgatgttgccattgcccgcctgagtaaccgtcgcacgctggccgctgccgaactgcccacccgactgcgggcctttccagttgctggcgtaaaccttgttgtcattgcctaccgaagtggcgttgagcacatggctgtcgccgttctggtaggtgaagtgcacgttgccgttacccacctggtacagcgccagcgtcgagttgaccgactcgaactggtcggcgtagatcgcgttgctgttgccgacctgggtgacggcggcgctgttgttttcgccaaagctctggtcgaccacggtttcgttgctgtcaccgtactggttgacggtggcctggcttgccagttgcgagtcttgccagatttcagtgccgttgaggttgccgaactggttgatggtgatgttgccgccggtgccgttgcgttggtcgccgtaggcgtagttgccttcgccggcctggttgatgccgatctggccgccgttgtgcagcacttgttcggcggtgccgtagttggcggtgccgtactgggtgatcaccgcgctgttgccggtgccttcatagagttgctcgatgttggcttcgttgctgtcgccgaactgcaaggttttgccttcgctgccgttctgcgaatcctgatagacgaacgagaagttgccggtgccttgctgctgttgcagcgcgttgttcggtgagccgaagcccagtgactggctggcgtgggcggtgttgaaggcgccgacttgttgctgggtgatggtggcgttgtcttcgtaaagctgttcggcgtaaccggcgttgtagtcgccgacggcgtcctgggtgatcacgctggtggcgtggtcttgcacggcggcggcgtcgttgccctggcccagttgggtctgggtggcgctgctgaacggtgcctgggtctgtttcacatccgcgatgttggcggtaccggcctggctctgggtggacaggctgtcgtcggccatggcctgggcactgatcatgaccagcagggcggcggtgaggggcgtcagtttgaacatgattgaactctccgatgatttgcagtgcttagcgatattgcttgaccgaaacgctcatgccgttgcccgactgagtcacggcgctttgcagccccgcgccggcctgctcgatgctggcgtcgttgttgttgccgttttgcgaaatctgcgcgcggttatggctgccgttttgcgtgatcgcggcggagttgccggaaccgttctggttgatcagggccatcaggtcgctgccctgttgcaggatgtacgcctcctgattgctgcccgactgcacgatctgcccgagcagcgactgaccgttctgttgcagaagggcgacgttggcctggccaagctggtcgatcagggcttgctgacccaccggtgggggcagttcgccgaggtcgctgctggtcggggccagatcgtcgttgtccatcaggtcttcgccgcgcacacccgcactgccgcacagcagaagcaggcaaagcagggcggcggtcggcgtgttcatggctcacatcctgtcaggcgttaaccggtttcaaattagccccagccacccgagagcggctggggatcaggcctacagcgtggtcaccgagactgtgcgcacggtgccttgggacgaacggatcgtcgcggtcgggttggccgatggcactaccagcgtgttgttcagcgtcagccgccagcgtccggtcaacggcaccgtggtggtgccaagggtgaccagcccggtcggggtggtgacctgcacggtgatggtgttgccggtggtcaccgatgaagtaccggtgaagtcccagttgaagcgcccgccggagcgtgcctgcaccgtggaggcggtgacggcgaacgtttccgccgctggtcttggcgacacttgcaccgtgaccgtggccggcgtcgacagggcaccgaagttgtcccgggcgatgtaggtgaaggtcgtggtgaacgccgtggtcacggtggccggtggggtgtaggtgatcaccgtgccgttgctgctgaccgtgccgcgaccagcggcgggttgggtcaggctggcgacggccagaggcacgttgccttccgggtcggtgtcgttggccaacacgttgatcgggatcgccacaccgagcgtggcgacggcgtcagcgacggcggtcggtgcctggttcggtgcgacggtaatcgtcacggtggccgggttggccgaagccaggcctttggcgtcctgtgccttgtaggtaaaggtcgtggtcagtggcgcgttcaccaccgctggcggggtgtagaccacggcagcggtgccgctgagggcgacggtgccttggccggctgccggttgggtcaacgcggtgatgcccagcggattatcgccatcgggatcgctgtcgttggtcaacaggctgagggtgatcggcacgccgaagctggtgctgccggtgtccgcgttgctgattggcgcctggttttcaccagtgtccggcgcagtgccgaccacgacgacagcctcggtgtcactgccgccggcggcggatttcaccgtcacggtggccggtggctgagtcaggtcggcaacggtaatgcgctgcagggtgccggtcttcgacagacgtccgtagccttgggcaaccatgtccggaatcgccacttcatcgctcgatgtcgcttcgatcaacaggcttttgttggcccagctgtagcgcgcggtttgtactttcacgacgtcggtgagcttggccgagacggcggtcggacgcgtggtaccggtggggttggtcgcggtcacgacgactaccggaggtaccgcgccagtgcccaatcggtggccgaagaacaggccgttgttgtcacccaacaggctggtctggcacggcgtcggcggtgggccgggcagcagcgccacgctttcgcggaagcacagacttgagctgttagccgctttggcgaacacttcggcacgcacgccggcagcggtgcggcgataggtggcgcggtcgatttccacttgggtttgctggcggttgtcgagcactttgccggacaggctgaacacgttggactggatggttccggcaggcccggtgatccgcaggaagttggtgttgaacgggctgcccgtcaccgcttcgttgaggttcgggtcgccgacaaacgtttccgtggcaccggtgtccgggttcacttcggtgtaggggccgttgacgctgcgcaggaacgggccgatggcaccaccgacagcgccggagaaattacccggcgcgccaatgccgatgtcgcgagtgatgttgatcgctcgccgaccgggggcggtgacgttgaccgtttccacgccataggggtgagtgatggtgtaggtgccggcaacgggcacgttcacccggatgcgaatccgcgcgaagctttgctgatcaccatccacaggattttccgaggcgaacgctgcttctatcccggcgacataagcatccacgccatagccggcaggattgtcggcaattgctgtttcggccaggaaccagaaggcttccggcggccagttgtcagggaaaatcatcggctgggcgtcgtcgtagatccccggctcggcgagcaggatgcacatgtaggccggcggcgtggtagccgccacgcgcgagctggccgcgcgcgactgacagagctccatcgacagctgattttcgtcctgataccacatcgggaatttcccggtggcgaaggtgtaggggccggggtcgacggcggcgagttgcgcataggcactgccggtcagcgagagagcgagcccgagcgcgttgagcgcaaagcgtggccacttgttcatgatgcctcctgatgcggatctgggcatgtgagcgttcattgcacgatgaccacttcttcggtgtcgctgccgccgttggacgacgtcacgcgaacccgggacggcggaatcggcgagatcccggtggccagcgttttcaccgcgccgtcgccaccgagtgcaccgatggcggcgccgctgccggaggtggcggtgagtagtggcggtgaggtttcgtcgctggtcgaggctacgacggtgagttgtccggagctcaggctgtattgagcgctctggatcaacaccaggtcggtcagggccatgggcagggtggtcggcgtgctgctggcgatggccaggtggttgtcggcggtcacctgcagcgtggtcggcaaggtcgggttggccgacgactgcgcgtaccagctaccggtgctgttggcctcggtcatgttcagcacgggcgtgctgctggtgatggccgctgtgcccggtgccggcggcgcgaggacaaacacgtcttgctgcgccaccggtgcgctgtcgccggccttgcgtgagtaggtgctgcgctgcgcgatcatcggcgtgggtcgaaccacggtcgacaacttgccggagacggcaaaggtggtggcgcgcagatccagaccgttcgggccttcgatgcgcacgtagttggtgttgaacgggctgccagtgaccgcctcgctgaggttcgggtcgccaacgaattgttcggcggcaccggtcagcgggttagtctcggtgtaggggccgttgacgctgcgcaggaacgggccgatgtcacccttgagcgcgccgtcgtaggttttcggcgtgccgatgccgatgtcgcgggtcatgttgattgcacggcggccgggggtgtcgatgttgaacacgtcgacgccgtacgggtgggtgatgacgtaggtgccggcggtcggcacatcgacgcgaatacggatccgcgcaaagctgacttgatcgccctcgaccggttcctcggcagcgaatgcggcttcgatggcgctgacgtaggtcaggtcgatgccgcgtgcggcgtcgacaagggtggtctcgccggtgaaccagaacgcttcatcggggaagttgctcgggaacacgatcggctgggcgtcatcgaacaccccgggagttggcagcagcgagcacatgtacgacggcgcgccgggagcgctgggcacccgcgagctgagtgctttggacaggcacagatccagcgtgcgaccgtgggtgtcctgataccaactggcgaaaccaccggtggccggcgcgtacgggcccggatcaacagcaaacaaagcggcctgggcaatgccctgggccaaggcgctcacgaccaggacggtcgcggttttggacagtaaagggtgcatgagttaatccctctatcaaagtacctgccccttggggatgggtcagttgcaggggcctgtacaccttccatgccaaggtgcggtgaatgggcgggagaaggccggattagaagggttcgcaggaatgaagctggggtttttggccagcggggaaagggcgtcattccccagaatcggggacggtggggatgaccatcattgcccgccttacacaaaccccctgtaggagtgagcctgctcgcgatagcggtctccctgtaccaaaaatctcagctgacccaccgcgatcgcgagcaggctcactcctaaaagggattagcggtgtctgtgggatcagcgcaaccggggcgatatccccgcaaccgggcaaacccccacccgtgggctataaccctatagggacgtatagagaagtcgccgccatgaacatgcagtcgaaatcgctaccggtcgaggagggcaatctgcgcttgagctcgcgcaagcagtcgttcaacctgctgcgctggttttcgctgatcagcatggcggtgattggtaccgtggccatcgcgcttggcgcggtgtcgacgcgttttgtcattgatgaaagcgtgcagcgtgatgccttgctcaccgcacagttcattcaggcgatcgcctcggccgaggtgcgccatgtgtcgattcccaacgtgcggaccatgggtgaattgcttgacccacgtcaggacacgaactttcccgaggtcagtccgcaagcccgggccgatgctcggggcgagtttctcgatcacatcgaacacttgccggacgtgattctcgccaatatttatgcgcccgaccgccaggtgatctggtcaaccaaccccgcgctcattggtaccaacattcatgccgatgaagaccttgatcgcgcctttaacgaaaaaacccccgtttctgccagttaccacgatgtcgacaaggcccgcgaagaacagaaattcatcacgccgccggactacatcttcatcgagaactacattccgctgttcgacgccgagggcaagaacgtcacggcgatggtcgagatttacaaggaacccaaggatctgatcgcgcgcatggagcgcgggatggtgctgatctggctggccaccgcgctcggcggcgggctgatttatctgggcctgtactggatcgtccggcgtgcggcgattctgctcgcggcccagcaaaaacaactgatcgccaatgaaacctttgtcgccctgggcgagatgtcttcagcggtggcacacagtttgcgcaatccgttggcgaccattcgttccagcgctgaactggcgctggagttcgatgccggcccggccgagaagaacatcaacgacatcatcggtcaggtcgaccgcatgtcgaagtgggtacgcgaactgctgcaatcgctgcgaccactcaacgatgacccggaaccggtgaacctggtggcggcgttgcacgaaagcctggtggcgttcgaacaacagatcgccagggccggggtgagggtggtgtttcatccgcaacacacgccgatggtgctcagccaaccggtgcaactgacgcagatcctcaacagccttttggccaatgcactcgaagcgatggacaagggcggcacattgaccgtcagccttgaaccaagcgatgaccggggtgtgtgcgtggtgctaagcgataccggtaaaggcatgaacgaagagcaacggaccatggccttccggccgtttttcaccaccaaaaccggtggtctgggcgtcggcctggtgctggtcaaacgcatcatggaacgcttcggtggcggcgtgaccctcgacagccgcgaaggcgagggcaccaccgtgcgcctggcctttcaactcgtcccctgattcacacattccccctgtaggagctgccgaaggctgcgatcttttgatcttgatcgttcccacgctctgcgtgggaatgcctcaagggacactccgcgttccaatgggacgcagagcgtcccgggctgcattcccacgcagagcgggggaacgatcactcttaaagatcgcagcctgcgtcagttggtacacaagtttataaacgctgcaaaaacttatgaacttcccccaccagtgggtgtcaagccccggtcaccgggaagtggggaaacccacagcatccccaagcccctgttacaactggaaataatttcttggcgcactagttgcaaaacaccatcaccccttccttgatgaggcggctggtgatggacagaacaacgcgtgccccaagcaacaccttcctgctgacgccgttgagcgtctttctgatgttgaccctcggcaccatggccggcgtccgcgccagtcccattgatgacgagcgacagccagaagtctccgacccctcggcttactacgacgaaccggccgaccgcgctggcgcgctaaacgccattctgaccatgccggaggccaacgaagactccttcgatctacctgacggggtcaaaggcgatcgcgctgaaacgcgtatcgaaaacgtcctgccaccctccgtgcagaccagtttcaactaccccaccaacggcaagccgagcccgctctatggcgcgcagccgttcacccagcagttgaccctgttcgaagagttcggcccggaaaaactcgacccgaccaccccggccgcgccgctgccgtttccaccagcggcgatcggcccggcaccggcccaagatccgaacaacatcgcccgcagcgcgccgcccggcactgcgcttgatgcgttcctgcggcaacccggtctgacgccattccccagccagttcgccaacgtcgtcgaccgcaatccgtggcaggcgcagatcgaggtgtacctcaaccggcacatcggctcgtccgccgaagggcggccaccaggaaaaggctgggcgcaccagcgctggaacgagttctacccgcaagtcgcctacaaaaccgtgcagaccggcgcgcgcctcaatggtggcctgcgtgacagtgtgcaaatgcaccattacgccgtcggcgaattcggccccggcggcctgtatcacaacgtcgctggcgtaccgctgaccgatggcaccgccaaaggtgtcgacccgcgtttccacccggccatgccagcgcaaaaccacaactcggtgtggaccttcgacggcacgttgccgccaaaactgttgatggtgcgctacggccaaccggtgatgatgcgtcactacaacggcttgccgatcgacccgtcggccaaccgaggcttcggtctgcatacgatcagtacccacgagcacaacggtcacgcaccggcggaaagcgatggctatgccaacgcgttcttcttcccggggcagttctatgactatcgctggccgatccagctcgccggttacgacagcatcaacaccaaggctgaagacccacgtgcggcgttcccttgcgcaccgggtgaaaccttgtgggtcaacgacctcgcccccgcgaagaaaacctgcgaccacggcacgatcaaaatccgtggcgactggcgcgagaccatgagcactcactggttccacgatcacatgctcgatttcaccgcgcagaacgtctacaaaggcaatgcggcgatgatgaactattacagcgcgctggatcgcggcaatgaatcggtggacgacggcgtcaacctgcgtctgcccagcggcagcgccttgccatggggcaaccgtgactacgacgtcaacctggtgtttgccgacaaggcgtgggatcaggaagggcagttgtggttcaacccgttcaacaccgacggcttcctcggtgatcagttgctggtcaactggcagtggaaaccgaccctcgatgtgcgtgcgcgcagttatcgcttccgcatcctcaacggctcggtgtcgcgctacttcaaactggcgctggtgcgggaaatcaaaggcaccagcggcgagttccaggggccgaaaaactccggcgtgtcgtacagtcgcgtgccgttccacatgattgccaacgacggcaacatcatggaacacagcgtaccgtttgacggcagcatggatctcgatgccgatggcgacaaacagaaccacaacgcgatcctgccgactcagggtatcgccgagcgcttcgacatcatcgtcaacttctcgaaaaacggcatcaaaccgggggacaagctgttcttcgtcaacctgcaggctcacgacgacggtaagggacccaaagatgtcatcccgctgggcgacatcctgtcggagagatacctggcggtgatcaagcagaccagcaagggcccgcagtgggacagaggcgatccggcggttggcaaggtcttgcaactcaacgtcaaggcgtacaccggccaggatctggcgatgaacccggcagcctacgaaccggcgaaaccgggcaaggctgaagggctggtgatgatcccgctgaagcttcaccgcgacaatgctgccgacaaagccgtgctagccaaggctcgccaccgcaccttcaccttcggccgctccgacggcaccgatgaagcgccatggacggtcaagaccgatggcggcttcggcttccacatggacccgcgtcgcttgaatgcttcgactcagctgtccagcggcccgaccgatgccggtatcaccgggttcggcaccctcgaagtgtggaacatcaaggccggcggcacgggttggagccatccggtgcatgtgcacttcgaagaggggatcatcctcagtcgcggcggcaaggccccgccagagtgggaaaaatgggcgcgcaaggacgtctatcgcatcggctcggaaaaggacggtctggacagcgtcgaaatggcgatcaacttccgcgagtttgccgggacgtatatggagcactgtcacaacactcagcatgaagacaactcgatgctgctgcgttgggaccttgagaagcccgggcaactgcaactgatgccaaccccactgccaagctgggacggtgtgcgctacgtcaactctgccgcgctgcctaccttccgcaacggtgacggtgttggcccacaagtggtggtcaaaccatgaaccgccggcacgctgaccgcctaccgcagcataccccgcgttcccgggcgctgggcatgcacctggtgctgatgctggtggcctgtgtgctcggcagccgtgtgctgctggcacaccaggccagcgtcggcgaatcgtcagcggccagtgaatccgccaccccgtggggtggcgactatttccccaataccttgctgaccgatcaggacggtcggcaggtgaatttcttcgatgacctgatcaaagacaaagtggtggtgatcaacttcatcttcacctcgtgcagcgactcttgcccactggaaactgcacgcttgcgccaggtgcagaaactgctcggcgatcgggtcggccaggacatctttttctactcgatcagcatcgatccgctcagtgacacccccgaagtgctcaaggcctattcgcagcgcttcaaggtcggccccggctggaagtttctcaccggcgagttcgaagacgtcaccgacttgcgcaagaaactcgggctgttcatcgaaggtgtcgacaacggtcgcagcaaggatcacaacctcagcctgatcgtcggtaaccagagcaccgggcgctggatgaaggcgtcgccgttcgaaaatccgtggatcctcgccgatcaactggccaacaccctgcagaactggaagcagccgagcatcgaggaaagctacgccaatgccccggacattcgcccgcccagcaacggcgaagaactgttccgcacccgctgcgcctcctgccacagccttggccccatggatgggcagggcctcggcatgcgcagcatcggcccggacctgatcggcgtgacccgcaaacgcgacccgaaatggctcaatcgctggattcgcgagccggatcgcctgctcgcggaaaaagacccgatcgcgttgcaactgtatgaacaattcgagcgaattccgatgcccaacctgcgcctcgacgagccgtccgcgcagtcgatcatcgactttctcagtgaagaaaccgagcgccagcatccgcccaccgctgccgtggccgacggggcgttgacgccagtaaaaccgggcgatccagccgcagcggtgagtcgtatgcagtagcggcgaaatagcatcattgaaccgtgtgtcgcggtcagagccacctacactgatctctgtacgcgactcgatagaaaaactccagggcactcccatgcagcgactggaagcacaaaaaacctctgcaccgaacccatcggtcgcaggcaagggctggcgcgagcagttcaatctgctgcgctggttctcgctcgcgagttttttcatcatcgccgccgtggcgctggggttgggttatatctccacgcgcttcgtggtcaccgaaagcgtcgagcgcgacgcgctgctgactgcgcaattcgtccaggccatcggcgcggcggaaatgcgtcacgcgaaaatcaatccgaaccggacgatgggcgagatgctcgacccgcgccaggacaaccactatcccgatgttgacccggcgttacaggcttcggcacgcaccgagtttctcgatcacgtcgaacacttgccggacattttgctcgcgaccgtttatgcgctggatcgcacggtgatctggtcgaccaacgctgagcttatcggcgtgcacatcaaggatgacgatgagctcgacgaatcattcgagatgaaagtgcctgtgtcttccagctaccacaagatcgacgatgagaaacccgagcagcaaatgttgcgcgaaccgaaatacctgttcatcgagaactacatcccgatgtttaacgccgacaaaagcaaagtcgtcgccatggttgaggtctacaaggagccggcggatctggtcgatcgcatcgaccgtgggttcgcctcgatctgggcggcgacttgcttcggcggtgcggcgatttttctagccttgttctggatcgtccggcgcgcggcgaaattgctgcagagccagcagcaacaactgatcagcaacgaaaccttcgtcgccctcggcgagatgtcctcggcggtggcgcacagcctgcgcaatccgctggcgacgattcgttccagcgccgaactggcccaggagatcgccagccccggtgcgcagcgcaacatcggcgacatcatcagccaggtcgatcgcatgtcgcgttgggtgcgcgagttgctggtgtcattgcgaccgatgaacgacgacggcgaggccgtcgatctggtgttggcagttgaagacacctttggcgcatttgatgcattgatcaaacgcagtggcgtcgaagtgcgattcagtccgcaaaactgcgcgccggtcgtcagtcaaaaggtgttgctcacgcaaatactcaatagcctgttcgccaacgccctggaagccatgcccaagggcggtgtgctcagcgtcgaattcgaatcaccgcagccggaccgcgtgcgcatgaccctgagcgacaccggcaagggcatgagcgcgcagcagcaactgttggtgttcaaaccgtttttcaccactaaacagggcggcctcggggttggtctggcgttggtcaaaagaatcatggagcgttttgaaggttcggtcgtgctgaccagccgcgagcaggaaggaacccgcgtcagtctcaacttcaaagtggcatcgggaggggaatatggaacacagcattctgctggtcgaggatgacgaactgttggccgaaaatattcagacctacctggagcgcaaagacttcgaggtgaccgtctgccattcggccgaggacgcgctggcgcaactggaaaccttcatgcccgacatcgtgctgaccgacaactcgctgccgggcatgagcgggcacgagctgatccagaagctgcgcatcagcgcgccggatctgaaagtgatcatgatgaccggctacggcaacgtcgaagatgccgtggtggcgatgaaggagggcgcctttcattacgtcaccaaaccggtggcgctgacggaactcaaactgctgctcgacaaggcgctggctaccgaacggatggaacgcacgctgtcgttctatcaggaacgcgaggcgcagaaatccggggtgcaggcgctgattggcgactcggcgccgatgcagtatctgaagaacaccatcggccagttgctcgatgccgagcggcgcatggccaacaccgatctgccgccggtcttggtagagggggagacgggcaccggcaaggaattggtggcccgcgcgctgcatttcgacggcccgcgcagcaaaggtccgtttatcgaattcaactgcgcgtcgatcccgtcgaatctggtcgagtctgagctgttcgggcacgagaagggtgcgttcaccgacgccaaggatcgccgcgtcgggttagtggaagcggcggatggcggcacgttgtttctggatgagattggcgagatggacctgctgttgcaggcgaagattttgaagttgctggaggatcgcaccattcgccgcgtcggttcggtgaaggagcgcaaggtcaatctgcgggtgatcagtgcgaccaactgcaacctggagcaaatggttcagcagggcaaattccgccgtgatctgtttttccgcttgcggatcatttcgatcaaggtgccgcgtctgtatgcgcggggtgaagatattctgctgctggcgcggcatttcctcgccagccatggcaagcgttacggcaaaccgaatctgcatttcagcgatcaagccgaggagttgctgctcagttacacctggccggggaatgtgcgcgagctgcgcaacatgcttgagcaaacggtgttgctggcgccgagcgacacgattgctgcgcatcagttgaacgtgtgcatgagcctgtgtgatgagccgccgctgcatattcatgaagcgccgatgcactacgaaccgcgcccggcgagcaacaccgaatcgatgaacctgccggaagtcgaacgcgacatggtgcgcaagatgctcgacaagaccgactggaacgtcaccaagtccgcgcgtctgctgggcctgagccgcgacatgctgcgctaccgcatcgaaaaactcggcctcgcccgcccggataaacgccagtggtagccccaccgcaaatcccctgtaggagtgagcctgctcgcgatagcggtgtgtcagtcgaccttttttttgctgacacaccgctatcgcgagcaggctcactcctacaagggatcggaggtgccggatcaatgctgctgccggctcaaacactccagcaaacaactcggatccagcacctcgtcattcacataaatcccgcgctcggcatcgtacgtgcgaataaacacccgcaccgtcgcatccgccaccgtcggcaattgtgaatcgtagaactcatggtcacccggaatcaccacaaaatcctgcggcgccgtatcgtcgtaaggtttgggcggtgtggaacccagcgaatacggagcagggtgggcgaagggctggttgggcccgtaataattgaaattgctgtccagcgcttgcgcctgagtggcagcgagcagacagccggtcaacaacagccgatcgagcatttgcatggcggcacctgcgagtgcggttttccccaaggctattaactatagctgcccgacattcaaacaaccgggtgattgatcacatgtcccggctgtgcgcaggccttgaggacatagccgattgcgcgaagaaactcttcgttatccccgtctgcaagaacctgggacaggtattcgctgatggcttcgtcactgtccagcaatgctgccacgtcgaaaatcgttaacgtctggctcatggttaaacctccttagccattttttgtgcgcgtcggatgtctgcgctttgtgaggatatccatgtgagcagagttgaatagtcagccgtgtccgctatctgttttgataattcgccgacacttgtaggcatgaacactcagatatgtaggagctgccgcaggctgcgatcttttgatcttgacctttaaaaaacaagatcaaaagatcgcagcctgcggcagctcctacacgaattggcttacaagtttgcaacaaccgcaattgaagagctgatctagactcggatccgctcaatcacgagcatcgtccggagtgcgccatggaagtgcccaacaataaaaccgccatcgagagtaatcgacaggcgtggaacgattccgcctgccatcatcaggattcgcctgattggcaggccttgctcggcgaggttgcgcaggcggatttctcttgtcttgatgagaccttgagcgggttgctggaagtcgacggtaaagatgtcattcaactgggctgcaacaatggccgtgagagtctctccctgtttgctctcggtgccagaagcgtggtcggtgtcgatcagtcgacggcgtttctcgatcaggcgcgtgagctgaacaagcgttcaccgcataacgccgagttcatcgaaaccgatattcatcacctgccagcgtctttgcagaaccggtttgacgtggcactgatcaccattggtgttttgaactggatgccggacatcggtgagtttttcggccatgttgcttcaacgctgaaaccgggtgggaaactggttatctatgaaacccatccatttctggagatggtcgatcccgacgcagaggatccgtatcgcctcgccagttcgtacttccgcgccgagccgtttgtgcaggaagaaccgattgtctatgtcggcaaagtcgagcagcagtcggcgaagtcgtattggtttgtgcatacgctgggggcgattttcagcggtgccattgcggcagggctgaacattgcgcacttcagggagtatgcgcattcgaatcgggaagaggtgtatgaccagtatctgaatcaagaggcgcagatgccgatgtgctttaccctggttgcctccaaggcctgattgatcgatgcggctgccggcctcatcgcgagcaggctcactcctacatttgaaatgcgatcccgtgtaggagtgagcctgctcgcgatggcggcatcaaagccgccacaaatatcccgactgaatcaagcctgcgccgccaccgtcactgccggtctttccggcttgcgcagcgcctccagccttgaatcgctgtagttcgattcgcggaagaaacgccagtgcccgaacaggtcgtaaacatgcgtgatatgcccttgttcctgatagcccaggcgaatatgcatcttcagggcctgtacattggcgttgtcgcagatatccacgacttttttaaagcctcgggcagacatgacttgccaaagtgcggtctgagcatcgacggtcaagctactgccgaaatagtgccgggtaatttcggcaccgaactggaagtattcaccgggcttgaccgggaacgtgcagcggtagaagtggcggtcgtaatagtcgcgagtgctggcccagacgaacccgacggtgtgatcgtcctcgtccaggtacatgtgccccgtatgcccttcagcggccagctcggccatggtctccacgcggtcaccaaagtacttgccgaatgccttggcgttgtcctcggtgatgtcgactctgcgcaaaccttcacaggggcgcagtttgttcggggcaatcggcgtgaccaggtcgcgctccatccacagcaattcacggtgagcgaagacgtaacgtttccacagcgcgccaagggtgcggcgcaggcctttttgtttgatgcgcagaagcagattttcgatgacgctcatgatgccctccgaggcgctagcccaggtgtgttggatggtgttgccggttgaatttcggatgtgttcgccgccgtcgagttgccggcacgcggtgcgcgccatttttgcagggccggtttgacgtggtgccaaaggcgtagtcccaggcccagcagcagaccgctcgggcgccatgagtagaaactccagcgccagtgttccagttgcccggtcatgcgttcgtgcagttgatggctggagttttccaggctgacccgcgacgcgtcgatccagcgccagtgctcatccagcccccaacgaatccattcctccagcagcacccggccgctaccgaggtcggcgtactgcggcaaaaacgccaggttgtaatcgtagagccggccctgttcgagcaggccgaggcgatagctgatgcagcggccgttcagctccagcgtcacgacccgcaccaggccttgggcggcgagggcggtgaaggcgctttgcatccactgacgactgcgttcggtggcgaaaatcccgacgccctcgtcacctttccagctgaccgactcgacttcctgcagcgcttctaaaatcgtaggcatcgacagcgcatcgggggtgattcgccgtacttgcgcaccgcatgcggcaatccgtttgcgcgcccgacgcagcttgtagcgcgggtcgccggagatctcctgatgatcggcatcgctgatcagatgcaccggcacccggcaactcaggcgccgttcagccgtggaactgcgcgccatccattcggtgagcgcactttcttcaccggcaggttccgacagttcattaagttgcagcagcgcatggggcagatgtttgcggatcagcaccagcgccttgtgcatgtcttcgctgccgagcaacgacagcagggccaggcgatcggccattggataacccaagtgatgcaaaacgcgaaacggtacgccagcgaagcgttcgcggctggccaccagtggcaggcacagcagcaattgctcggcttgccagccgagcagaatgtgcaggcgctgatcctcgcccatggcctgctctgccgcgcacaaccagccaaggttgttgaacggcgtttcgtcagctacgcgcaggcgtagtgcttcgtaggctgttgccgggaagtcggtagcgcacagggaggtgcgccattcgaatcgcatcaccatgggttcaggccgccgttgctttgacaggtggacgggaagttttacccagcgccgccagacgcgagacgctgtagcgggtttcgcgatagaagcgccagcggccgaacagcgtgtagatattcatgatccgctgttgttcggtatagcccatgcgcaggtgcagcttgagcgccgggacattgctcgagtcacagacatcgaccactttgcggcagcctttcaaggccatggcttcccacaggcgcagttgcagatctaccgacaactcggtgccccagtaggcacgggtcagttcgccgccgaattcgaaaaactcgccgggtttaaccggaaaccggcagcggtagtaatgccgatcgaaatagtcgcgtggcgtgccccagataaacgccacggcatcgcctttgtcgtcgacatgcatatgcccggtgtgaccgtcactggccaaatcggccatgacaccgacgcggttgccgaagtagcgggcaaaggcgctgacgttgtttacggtgatcttcagcatgcgcagtggcgggtagggtttgaggctgtgcggcggcacggggctgaccagatcgcgctccatccacagcagttcctgatgggcaaaaatgtacattctgcggatcttcgccaaggtcgctcgcaggcctttacgacggatatgtccgcagagtcttcgcaatacatccatggtctcttctcctgttaagggtcccacgcacagcaaaaggctcgcggggcagaacatcgaagggcggttcatgaagcgctccaggtcagggcaaacagggtttgccccggtaattcgaaacgtacgcgcccgttttcgcaggcaaacggtatgtcgcggctgcgattgtcagcgccgaagaaacgcagggcgctttggttcagcgggcacttggcaccgctcagatcaacgcgttgcaggcgcgtgcctttgttcaccccgagcagtgcgcgctgctcgtcaccggccatcgccaggacatccacctcaaaagcgtcgttatccagttgcagcacttgcggcagccaatgccgggcgatgaattgctgggcaaggcccaccggtttgagctcgaagcgaccatcgtcgtgtatgcgcaccatgcccttgccgtagggcggttcgtcggcggcctgaaaccagttgagcatgctcagcagtccatcctgagaagcgttgatcaccaccgaggcccaccacagcgcggtgtaatgggtttcctgatcgtaggggctcagggccgagccactggacagattggtctgatccagcagcaacgctttacgtggctgacctttagcgtccagccccaccaggtctgctgcgcggcgcacgctgtcgcggtagacccgggtggccagcaagtcgcgaatcatccattcatgccaggccaatgcatcgacttgatcggcggattcactgagtagacgccgcgcccaatcgatgccgcgcttgtccgctgcgttttcggtgaacggcccattgaccagccgcgagctggccggcattgcgatgcgcacgccagccttggcgttggctgggtcgctgcgcacctgccgcgccatgctgttgaagatcgcccggtattgttcgtaacttgaatagttgagattaggctcgtcggcgaaaccgatgtaatgcgtgcctttgccaccgagggcgcgggtgccggcgagccaggcgtcgaggccgctgttgctttgtgcgtcggcgcgcagatcggcctgacgtccggtgccggcgagcagggtgatgtcctggcgaatgccgaagcgattttgataaagctgacggaacgcgtcttcgaaatgtggattcttcgcggtgacgtcaacgaagctgtagtaactcgctgcccccggcctcagtgcatcaagtaaggcatggctggcgggtggtggcacgaggtacggcagagcaatgcccagatccggcgtgcggccgagaattttatcgtgcagggtcaaatgcgtttgccccggatcttcgcgcaagggctgcaactgctgcagattttgcgcaaacagattggctgtgccgtcgagccagaatgccgctttgccagtgcctcgcagacgcaggcgccagacttgttcctgttggctgaccggcagcgcgacttgatcgaactgccaataggcacgatagggtttcagtgccagcgtcagcgtttgctcatcgcccacccgctgtgcctgcaaaccgctgacgccgccatggaacttgccggccagcaccgcgtgttcaccgggtgcgactctgaaatacagctcagtggcgttacgtacttccgcgctgaaatgcaccttggccggggcaaacagcgccacggttttttcgtcatgttcaatccgataactacgaaagctatagccgggaatttccagtcgactgctggcagccccgggcagcaaagtccagctctgcgaaccgcgagtttcgctggctttgatcagccgttcgccctgtagcttgccctgaccatcgagcagataaatatgctcttcattggcctcggcctgccatgccggcacccatcgcactgttacggtgtccgggcgctccgcttgcagatacaaactgccgtcacggatatcgccccactgcatcggcgccgcgaaaccgttcagcgtcaggccgagtccgaacagcagggccaggcgtttcatgctgtcttccgacgttgcagcatcaaccacatcggggtgatgtcgctgggcaggatgatcaaggtttgccagaacggcacgttgctcaagcggcaataaagcaccagcatcgccaccgtcaccgccagataggcgattgatgaagccgccgcagcaccgacaatgccgtaggcaggaatcaacagcagattcagcgccaggttgaacagcgcgccgatgcccatcagcaacgacaccgtgccggggcgatccttgccaatcaggtccaggcgcagaatgctcgcatagcacaggcccagcagaccgggcagcaacgcgagcagcgccggatacgccggttgatacgccacgccgaacagggtgacgatcagccattcgccgatcacagccatggtgatgcaggcgccgagcatcaccgtggcggtcaggcgtagggccagcggcgtgaccgtgtccatgcctttgtcctgttgcagcagtcgcttcatcagcggtgtggtgactgcctccggaacgatcagcaacagttcggcggcggcactggccatggcgtagtggccgagcgcggtactgcccagcagggcgccgataaacaagtagtcggagcgcagaatgatctgttgaaacagcaggtccggatggctgcgcgcactgaagcgcaacagctcgttctggctcgcacggtcccattgcagttgcagcggctgtgcgcgtttgagccacatccagccgaccagcaccaccaagctgatgccggccagccaactgatcagcgcggcttcgagtgctgcctctttccacatccagaacagcgcgacaaacaacagcagcggcgcgagggattcgatcagacgcagaacattgaaggcgaccacgccgcccgatgcgttgtgcaaggtcagcaagccgcttttaagcacggtcaacggcaccgccagcagcaacagccacgccagcagaccgagctgcatcgtcacatcgagttcgctgccgaactcacgggccagcgcgaccaccagcaaggtcagcagcccggccagaagacagccgaacaccaacacctgagcgagcaacacgcccatcggccgctgattggccgcttgataaccgactgccgaattcaaaccgccgctggtagccgcgctgatcaggtccggcagggtgctgagcagggcgaacaaaccgcgttcactggggccgagaatccgcgccagcaacacattgcgcagcaggcgtaaggcaatcattgccagtttggtgcccatgctcagggccagatgcttgaggtagctgccgcgactcatggccgtgccccgcgataaatgcgccacgacaacaacgccggattgcacgcgatgcgctgactgacgccgaagcgcggcaggttcagcgggtcgccttcgccgcgataaatgccggtgccggtgccgagggcgaacggataatcgtgattggcgatctgctcgcgcacgcgttcatcgttgtcgccgttggggtagcaatacaccggcagtgggcggttgcagccgttgtacaaggcatcgcggctgcggctgatttcttcgttcaggcgctgatcatccagcccggtgaggatggcgtggctggcaccgtgcgggccaaagcgcaccagaccggaagcctccagcgcgcgcacttgatgccagtccagcgcttgcggctgtgattcggctgggcactcatcggtgagtttttccagttcctgcgggtcaagcgtcttcaatccttggaggaaatgcagcagcgccaggctgcggcggtcgacatcgatgtcatcgagcaataccggcaatgggtgatgcatgaactgcaggcactcgatcaagtgcatccgcgctttttcaccgtggctgccccacagggtttcgccaaggctttcccaccagaaacgctgacggctgccgatgaaatcggtggagaggaaaatgctcgccggtacctgatgcttctgcaacagcgggaaggcgttgacggcgttgtcgcgccagccgtcatcaaaggtcagcgccacccgtgggcgctcgctgcgcagcgaattgggctggaggatttccatcagcggcacgcaatcgaaatgccgccgcagccacagcagtaaatgctcgaaggccttgggcccgacgcacagttcattgcggtgcgggaggttggcggcacggtcgttggccagcacccggtgcagcatcagaatgacccccgcaccgtgcaactggttgcgccccacagacgagttgagatagagccagccgctggtgcgttttagcagttgtttgatcgccatggcatgagtcctctcaacgattctggtcaggattccattgtgcgtagcgttgcccgcgcaggaactgccacagaccgacgctcatgccggccagcgtcaccagcaggaacgccgcgaggcggaacggtttcggtaaacggtgttgcgaatccagcaggccggcgatggccaccgcgtagccgagcaattgcgcaaccaggctcaggcgatagaaaccgtgctcgttccacagccagaaattgctcagcagcagcggcagcaagagaatcggcgcgaggcggcggatcagtttgtgactgatcagcgcgatggaataaaggccgtacttgaacggattcagcagtgcgctgcgttgtgccaggctttgcaggccaccgacggtgacccgctggcggcggcgccattgcttgcccgcttcgtcgacgccctggtcgatcacttgcgcttggggcacgtaaacgatgcgtttgtgcgcgaccggcgcgcaggtactgatgaagaagtcgtcgttgacctcggccggtacgttctggaacagctcgcggcgcaaggcgagcagggcgccgtcggcggagaccatgcagccggtgcgattctcgacccggcgcaaccagccttcataatgccgatacaggctgtcgccaatactcaggccgccaccggtgaccgggatcaccatgtgcccggcgcaggcaccgacctgcggatcgctcaacggcgcgagcaaatggccgagggtgtcgcgcgaccattggttatcggcgtcggtgaacaccagaatgtcgccgctgctcacggcgacgccggcattcagtgtggcggctttgccttggcgcggcaggtcgaggacggtgatgcgcggatcgatcactttgtgcgcgcaggccacggtgtcatcgctcgaaccgtcgctggcgagaatgatctgcagcgtggcgggctgataatcctgggccagcagggtgcgcaacttgtgctctatgtgccgcgcctcattgtgcgcggcgatgacgatgctgacgttcagcggcggcgccggcgcgtgccgccaggccgggaacagcggcgccagcaaggtcagcagcagcggatagccgatgtaggcgtacgccggcagcagcaggcacaggcaaaaaatgaattcagccacgggcgggcctcctggcgttccaatgacacagactgagaataagtgccgcgctgggcaggtgcaggcgtaaccagtgcagaccccacaactgcaaggtgaggcgagcgttgtggtgcttgatactctgccgcacgctgagcatcagactcggcagcagggtcagcaccagcaggatcaccgcgagctgcgcgaagccggcgagcaaggccacgatcagtagaaaatccgtcatccagaccagcaacgacagcagcggaaaacgcagcaggcgcaggctcatgccatgggtgcgcagcaactgcaggtggctgccctggcgccacagctccttgcccatccactcgcgccagttcatttcgtagccccaatgcagggcgatgctgttacgggtcgacagcagccgtgcgccttgtgtgttcagacgcaaggtgtattccttgtcttcgccggtgcgcagggtttcgttgaatccgccgacgacgtcaaaccagcgtttgcgcatcaacaggttggcgctgggcagccagtccacggtgcgactggcgtgcgctgatggacgcaacatgcgccgttgccaggcggtcgcgtaccacggcgcggcggcgggggtatgcaggtccaagccaaaaatgtcgccctgattctgcgcttcgagagcgaacaattcgttcagccagtcttcgggcatttcgatatcggcatcaatgaacgccagccattcaccgctggcaaccgttgcgccacgattgcgcaaggcgccgatcagcaggccgggcagcaccagcacctgtgcgccgaatgcgcgggcgatctgtggcccgtcatcagtggaaccgttgtcgacgacgatcagttcacagtcgatgtcggcggcgttcgcggctttgcgggcggccaggagggtgcggccgatgtgccgggcctcgttgtacatcggaatgacgatgctgatccggctcatgccctggcctccgtcagcggcgcctgctcggctttcaggcgcagcacccaggtcagcgcaagcatgatccacaggtatttcaggttcggcgcgctgagaaacatcagaaacaacgtcaacgacagaaaactcattcccagatgggtcatcaggtctgcttgctgccattcgcgccgttgcagccattcgcgtcgtgcgcggatcaggttgtagaaaccctgcacgagcatgccgacaaacagcaggccggcgggaatccccaattcgctgaaaatctccagataagtgttatgcgcccgacgatacagatcgccgatcttgcggttggccgagaacgccttggcataaccggtggttgcatagtgcagcgggaaggtcccggggcccgagccgagcagcggatgctcgcggatgatctggctgccgacgacaatgtacgaggcgcgacggccgagggattcgtcctgagccttggccccggcgctcaagatactcagcgactggatgcgcgccaggtaaccggcaggcatcgcataaatcgccaatggcagcacgatggcggcgccgagcatggcgaatccgaaatgccggggacggatgcgggtgaggtgctggcggtaatgccagacaccgatcgccagactcaaggccaataccaccagccctgagcgcgactccgttttggtcatgccgccgagcagcaaaaggcagcagccggcccagaacaaacggtgcagcaggttcgggctgcgaatcaccagcaacaggcccagcggcacggcgaaggcgatcagcagagcaaaggcattcgggtcttcgagcaggccggcagcgcggcccttgtcctggaatcggctggaaaacatcgccatcgcgcaggtcgcgctgacgctgagcgtgaccagccgggcgaacatatcgaggttcagctcgcggccgatcaacaaagtgatcacgaacagaatcaggcccacgctcagctcacgcagatgactctgtgacatgcccatattgtcggtggcgagcaggctcagcaggtacagcgccatgaaaccgatcaggtagcgccacagattgctgcgcaggcgctgcgatggaatctgatgcaatgccagttgcaacgccaggatcagcgccagcgaagcaccgatcagtttgctcccggataacacgctgtccttgaagaatccttcaaacggcaccagcgcggcaatgcccagcaggccccaggccggtttgcggtacagcaccgtgaaacccagcagccccaacaccgcccccggcgccagatacggataaggactgaccagcaaagccatgcagaccagtgccagcaggctgacgatcgagagcgggaaaatcatgcgcgtgcctcccgtgccgtgtggatgtacagctgcgaccagcgttcagccaaagccttgaggtcgtagcgttcctgttgtgtgcgtctggcgttgtcgcgtagttgtgcggccagcttcggttcggccagcaacgtgtcgagctgacgggcgagggcggcggtatcggtcggggcggcgagcaggccgttgtggcggtcctgcaagacatcgggaataccgccgaccgcgaatgccaccaccggcacaccggcctgcatcgcttcaagcagaatcatcggcgtaccctcggtgcgcgagctgattaccagcgcatcgagttgctgccaccagccttgcatcgccgtctgatagcccggcaagcgaatccgctgttgtaaaccgaccgcgtcgatacgcgcctgcaaggcctcacgttccggaccgtcgccgagcatcacggcgtccagttgcggatgctggtgacacaacgcaatcagcgcatcgagaaacagatccgggcctttctcactgctcaaccgaccaacgtaaccgaccagccagcgttgtcgttccagcgccggcggcagcactggcgccgctggcaaaccgttggcaatcacctgcaacttctccgcacggacgccagcctgacggtgcagcacagcgatgctttgcgctacgcagaccacccgcttcaccgaggccgtgcggcacagttgcagacttagccaggtgtagaacttttgcttgcgactgcgcggggtgaagccgtgctgagtggccaccagcggcaggcgcaacagcgttgcgccgacccagccaaacagttgtcctttgaagttgtgtgtgttgagcaacggcttgtcaccacggcgctgatgcaagtgccacagcagtccaccgagcccggcacagccgcgagcgtccaccccggcctggcgaaagcgctcgatcagctctggtggcgcgtcgaggaacagcacctgatgctgccccggcgtcgccaggcaatgatccagcaacatccgctcggcgccgtagaagccgccgctgctgagcaaatgaatgatcggcagggcgacgcacggggtggacgccgcgttcaattgcgcacccagtgaaccaggctcggcacggtccagttcttgtgcggattgccgggctgcgacgtttcttcgttgagcaccaacagcaccggcaggcccagctcatggctgatttgcgccggatgcttgaagcggtgatcgaagaactcacgtacatagacgaaggcaatggccagcagcagtccggtgagcaggccgaacggtatgatcaacatcggcttgggaaacgccgcctcggtcggttcatacggcggactcaggacacgagcgttggacaaatcgttatccagcgcgcgtgtcgtgctgctttcggcaaagcgttgcgcataagttgaaaacgctgcgtgcaatgcgccgatctcggtgtccatttggcgcagcttgctttgggtttgctgcaattgatggatgcgattcttgaactcggcaatgcgcgcggttttctgctcgatgacctggctgaccaccgacaggtcgatcgtgcgttcctggatgcggttgttgaccactttgaggaactgctggcgtgtgcgggcaatttgctcgcgggccagcaacatcggttcgctgctgggctgaaatatcgccaggtcgttcatatagcggctgacctgagtggtcagcgcctcgcccatctgccggatctcacggtcttcgaacgcgatgttgtctaccgtcgtggtgaaggtgaacggaaaggtgtagtcgttaagcttgttggtgttggcagcggccaggctggttttcaggtaatcgagccagcgctggctttgcagcaagcgatcgcgatacaggttgagtgcctgctcttcggtgttgatcgcgttgaggcgaaaggtgatttcctctttcggatcggacgaaccgacgctttccagcaggctcagccgcgcgccttccaggccatcgaggcggacctgatattgatgcttcttggtctcgtagaacgagtgcggcagctcgatcgattgcaacgcctgacgatcgaccagatagttgcgcagcagcgtggcaacgaacgtcgtgccctgggcgggatccgggaagctgtagacgatcgagatgacattggaacccggcagggtttcgatcttcagattgtcgatggcctcctgggtcaagccatccagtgccgtgtcgcgcaccggatcggtttccatgcccagtgcatcacgcagcggattgatcacgtattcgcgcagcggcgtgctgacgtaacgcttgaacggttcagccagtttgctgagcatccccggcggcgggttgtactgaccctgatcgcgcagttcgctgatggtctgacgaatcagcgccggcgaacggaggatattgctttcggtctccatgtccgccagcgatggcggaatgaaggtggcgttgtcctgggtcagcgaggtcgtcgcatcgccctgggagagtttttttgactgcacgatcacctgcgcggtgatatcgaagctctgtttgagcaacagcggcagcaacagcgcgatcactgcaaagatcaggaagatgcgcttcaccagttgcttgttggcgaagaaaatcctgaagaactcgtgcaggtaattttcttttgggttcatgtcgttcacctgagagtcagttgtcactgcctttgttgtcgacgcggtagccgaagctgaaccccacgccctggaacagcaccacatcggccagttggcgggcgagttcgccggcgctggccagtttggtttttggcacgtagagcatgtcgtccggttgcaggtaggcgatctgtggcgcatcgcccgacagtgctttctcgacgtcgtagttcatggcctgcacctgattgccgttgcgccgcatgatcactaccgaatcgagacgcgccttgacattggtgccgcgcgccagggtcagagcctcaagcaccgacaccggccggcggatcgggtacgaacccggttgagcgacttcgccgagcacgtagatctcgttgccggcggtggatttcagcagcacatccacagtcatccgtcccggcagttgcgcgtacttgctgttgaggaaggtttccagttgattgacggtcatgccttgcagcggcacagcgccgatttccggaaaactcgcatagccatcggtgccgacggtgatttcgcggctcatgccggtggccgggtggttcagcgcacttttgaggttttgctcgttactcagcgggctgagaatctgcaccgagagctgattgcggttgggctggaacagttgcttgcgttgataggcgcgctggatttcctgccgcgcctcgtcgctggtcagcccggcaattttcaccgaggtgttggcgcccggcagttcgatggtgccgtcaggcagcaccagttgcgtgccgttgagctgactggcagcggtgaagttcaggccgatctggtcacccgactgcacgcggtaagcgtccgagccgctggtactgatgtggaaaatcacatccagcacgtctttcgggcgcagggtctgctcgaccctcggcatgtcggtggcttgcgcattggccggtgtggcggtgaggatattcaccggcatgttgcgggtgtcggtattgctggagcagcctgcaagcggcagcaacagcaggacaagcattttggcgttcatggcgtcatcctttgcgttcgcttacaggtttttgtaaagccatttgggcatgtagtacttgcgccggttgaacacgctgccgaccacttttgccccggcctgagtcaggcgttgcacggcggcctgggcgacttcccagcgagtgtcttcggcgcgtacgacaagcaccacgccatcgacttgcgtgctgatgaccagcgtgtcggcgtcggagtacaccgcgtcgccatcgatcactacaaagcggtactggctgcccaattgatcaagcaacgggctcagccgctcggcggtcaggtgctccagggtgcggatcggccggccgttgggcagcacgtggaacggcaggcttgagacctgcaccacgcagtcctgcaacagcggcggtttgtcggggttgaacagcaagtcgcgcaggccgcgctccttgctcaggttcaactgctgggtgagattgctcgccgactgactggcatcgaccagcagcacttggccgctgctcatttgtgccagttggccggccagcgccagcgcactggtggtggtgcctgagccggggttggcggcggtcaggaacaggatccgcagatcaagatccagcacggtcgaggtcaggttcgattcgctggggttggcaatgctcaggcttttgttggttgaaccgtccattagcttgctccgtggccgctgaatactttgaagggggttttcaacagaatcttcagatcaagcaaaaggctctgctcggcgatgtagctgaggtccaactcaacgcgctggtcgaagtcgatgttgctgcgcccggagatctgccacaggccggtcatgccggggtagatcgccagacgcgcgaggtgattgtccttgtagcggtaggcgttgaacgaggtcggacgcgggccgaccaggcgcatgtcgccggtcactacattgatcaggttgggcagttcatcgaggctggtgcgccgcagaaaaccgccgatgcgggtgatgcgcgggtcgtggtcgatcttgaaatcgatcgcgtcggcaccgtgtttgttgaggtgacgcagtgactctttcaactcttcggcgttggcgaccatggtgcggaatttgtacatgccgaatttgcgcccgcgataaccggtgcgtttctgcacgaacatcaccgggccttcgctggtgaatttgatggtcagcgccagaccgatcaacaacggcgaaatcagcagcagaatcatcagcgcaccgaggcaggcgaccacgcgattggtgcgtgacagttgccatggccgaccgccgtcgcggccggtgaaccagccgcgaccctggcggtgaatcgctgcgtcgagacgcattcggtgctcgggatccacgcgcttgtcgcggcgcatttcgaggatcggtacacctttctcatgtccagtcatggagtcctccacatgaattcagccgcgaacggcgcgtgggcgataggcagtggggtagtagtcgcggaaccaggcgataaagcgcccgagtccctcatccagctctatccggggctgaaatccggtggcctgggccagatcgctggcctcggcgcaagtgttgagcacgtcgcccggttgcagcggcagcaactcgacaatggcggtctgaccgaggtgtttttccagcagcgccagataggttttcagctcgaccgggtgctgcccaccgatattgaacaggcgccacggcgccatgctgctggccgggtcgggctgctcgcgatcccactgcggattgacctgcggtggctgctcgatgaggcgggcaatgctttcgatgatgtcgtcgatataggtgaagtcgcgctggtgctcgccgtaattgaacagcttcagcggcgtgccttcgctgatcgcccgggcgaactggatcggcgacatgtctggccggccccacggcccgtacacggtgaaaaagcgcaggccggtgcagggaatgccgaacagatggctgtaactgtgcgccatcagctcgttggcttttttagtggcggcgtacagcgacagcggatgattgacgccgtccttcaccgagtacggcgtgtgctggttggcgccgtagaccgaactcgacgaggcgtatatcaggtgctcgaccgggtgatgccggcagctctcgagaatgttgaggaagccgttgaggttgctgtccagataggcccgtggattgtccagcgagtaacgcaccccggcttgcgcggcgaggtggatcaccacttgcggacgttcgcggacaaacagcgcttcgatggccggggcatcggccaggtcaaccgttgcgagctggaaatcgccggcctgctcacgcacccactgcacgcggtcgtgcttgagttgcgggtcgtagtagccgttgaagttgtccagaccgactaccgagtggccgtcgcgcagcaaccgcaacacgcaatgggcaccaatgaaaccggccgcaccggtgaccagcaccttcatggccgcagcccttctggggcaatgtggcgcagaccgatgccgctgtaatgcaggccggcggccgccacttgttccgggttgtacagattgcggccgtcgatgatgaccttcgagcgcagcttttcggcgagcaactcgaaatcgaccacgcggaagtttttccactcggtgcagatcaccagcgcatcggcgtcttccagggtgtcgtcgcgggtggcgcacaggtgcaggtcgttgcgataaccatagatgcgccggcattcggacatggcttccgggtcgtaggcctgcacgctggcgccttcggcccacagcgcatccatcagataacggctaggcgcttcgcgcatgtcatcggtattcggtttgaacgccaggccccaaatcgcgatggacttgccagccaggccttgcggaaattgcgctttgagtttgctgaacaggatgtgccgctgcaggtcgttgacgtcggtgacactgcgcagcagtttcagcggcataccgttgtgttcggcggtgtgcagcagggcacgcaggtccttgggaaagcacgatccaccaaagccgcagcccggatagataaagtggtaaccgatgcgcggatcagaaccgatgcctttgcgcaccgcttcgatgtcggcacccagcagttcggtgagattggccaactcgttcatgaaactgatgcgggtggcgagcatcgcgttggcggcgtacttggtcagctcggcgctgcggttgtccatgaacatgattttttcgtggttgcggcagaacggcgcgtacaactcgctcatctgttcgcgggctgcgtcatcgtgagtgccgacgatgatccggtcagggcgcatgcagtcggcgagggcgctgccttccttgaggaattccgggttggacactacccgcacttgcagatcagtcttgccgcgacgcagcaattcgctgttggcggtggccaacacctgatcggccgtgcccactggcaccgtggatttgatgatcagggtgcggtcagcttccatgtacgaagcaatttgccgggcgacgttgagcacgtggctgaggtcggcggagccatcctcatcggccggggtgccgacggcgatgaaaatcagctcggcatgctcgacggcgtcgctggcctgggtgctgaacagcagacggccggccttgatgttttcctcaagcgtgctggataaacctggctcgctaattggcggcactgcttgttgcagttgtttaattttgttggggtcaatgtccacgcataaaacgcgatgaccgacatctgcaagtgcggcggcttgtataagtccgacatagccagtgccaaatacgctcacgtccatctgcgcacctcagtaacaccaaaagttaactacggaatgagatagttaaaggggtatagcgcagcgtttgaaaagcgtgtcagcaaaatgacatgttgcatctgtataacacttgagcattttttggcgattggccatcaagtcattgctgcgattgaatttgttgctttcgtgcagatttgttcagatttcaaatatgcgataaacggtcgtaagccgctaatttaaaggcttgtagcgtcttggctgtgtcagatttgagtcaccgtttttttgacgctttctataaaaaacagtcaattcttgcgctttgatggccggatgctagtgtcaggttctgactgacaaacctttgactccctgccgttttgcccgatcggtatcgccatgttcagatatgccaaagaattgttcttaattgtttatttgttgatttattccgaatattacattgatcggttaaatgctatcggcttcggttttgctgtacttctttttggcgcgatgtttttggcgcttacttttgcgttatatctaatggcgtatataaggcaaactctcattcgccacgtgttcgcattggcaatgtttgtctcggcagtgtttttcgatgtttatacccgggtcacggcggactacctgacctacagcggtttcgtgtcattggtttactccggcggtttcatccaggaagcggcgtaccagtaccgggacgcgctcttgcgtggcgtgctcagcggtttgctgttgctgttcggcatcggcctgaaaccccgccacgggctggcgattcccaacgctttgcgtgtggcggcgccactgtgtggtgtgctgctgctcagtgccgtgctgtttttgcgtgcgggtgagggtgcgcggggcctgccgatcatgtacacgccgctggcctatctgaacctgtttgcctatgaagcgctgcacaacaccgtcggcccgcgcgaaccagtgacgctgacgcgtaacactcaagccgtcgatcacgacatcgtgctgatcatcgacgagagcatctccggcaattatctggacatcaacgcgccgttcggtgtgcacagcaacctcaaacaggcgcgtcccggcgtcgatatcttcaattacggctacgcggcgtccatcgccaattgcagcgcagacaccaacgtaaccctgcgctacggcggcacccgcgctgattacatgcgcatcaacagcacgttgccgtcgatctggcagtacgcaaaaaaggccggtctgcacacggtgtacatcgacgcccagcgcaccgccggcaatctgcagaacctgatgaccgaaaccgagaaaaaggacatcgaccagttcgtgcaattcgaccagaccagcgtgcgcgatcgcgacatggcggcagcggcgaagctcatcgaattgctcaacgatgacaaaccagagctggtggtgatcaacaaggtcggcgcgcacttcccggtgcatgacaaatacccggatgcgttcatggcctaccgcccgaccttgccgcgcgggcagttcaccgaggtggccgataccggcgaacgcaacggtttcaatggtcagccagatgattgggtgctgtatcgcaacgcctacaagaacacggtgttatggaatgtcggcgagtttttctcgcgggttttcgctcagggcaatctgaataacgcgtcgctgatctacacctccgatcacggtcaggatctgcatgagcgcggcaatcctggattgaatacccattgcggcggcgacccggtcgaggaggaagggctggttccgctagtggtgatccagggcagccagttgaagacgctggactggtcggcgcaactggcggcgaacaaggatcgctccagccactacaacatctttccgacgctgttgcagttgatgggctatgacctggcggggatcgaggctgtttatggcaagccactgagtgtcgcgacggcggatgaatttaccttcaactaccgcttcaatgcgcggctcggggccaagcctgaatggaagcacattgatctgggcagtattgtcacgccgacgcaggcgccagcgagtgtggcggcggggcaatgagttttggagggaatccgcagacctcatcgcgagcaggctcactcctacaggggaatggattccaaaagtaggagtgagcctgctcgcgatggcggtgtgaggttcattgaatttttgcgtttgcttccgatcccgccaagctttcggacgcatgccctacctgcaacaaactcaacgttcaattcaccgcaagattccgagcggtcatcggcatccgctatccttgccccacactgaccaatcaggtggcggcatgcttcgtgttgaaaatgtcttcaaaagctatctcacaccgcaaggcccattgccggtgctgcaaggcatcgacctgacgctcgaatccggcagcagtctggcgctgatgggcgaatccggcagtggcaaaagcacgttgctgcacctggtggccggtctcgacaaagtcgacagcggcagcatccgcagtggcgagcatcggctggaggcgatgaacgaggcgcaactggcgaactggcggcgcacagaaatcggtctggtgttccagcagttcaacctgatcggcagtctgcgcgttgaggacaacctggcgtttcaggcgcgtctggccgggcggcatgagccgcgttggcaggcgcacctggtgcagcgtctggggctcggcgatttgctcaagcgctatcccgagcaactttccggtggtcagcagcagcgggtcgcattgggccgagcattggcgtcgcagccgaaattgctgttggccgatgagcccaccggtagcctcgatgaggcgaccagtgatgaagtgctgcgcttgttgctggaattgctcgacgacacgcccaccacgttgttgatggttactcacagtcagcgggtcgcggcgcaattggctcagcgtgtggtgctatccaaagggcggctgacgtgatggtttttcgtcagacactgcgcgcgctgctcagccattggcggcgccatccggtgcagtttttcagcgtgctgaccgggttgtggctggcgaccagtttgctgaccggtgtcgaagcgctgaacagtcaggcccgtgacagctacgcccgcgccaaccagatgatcggcggcgaaccgcaggccagtctgagcacgccaagcggcgcgacgttcacccagcaatggtttgtcgatttgcgccttcaaggctggccggtgtcgccgctgttgcaggggcgcctgctgctcaaggatcacgaaaaccagcggctgcaattgatgggcattgagccggtgtcgctccccgccgattcggcggtggccgggcaggcgctgccgattgagcgtgttgtcgagtttttcacgccgccgggcagcacgtggatttctccggacaccttgcaggcactcaacctgcacgaaggcgacacgccgcagaccgtgaatgggctgtcgttgccaccgttgctggtgcaaaaggacatggcgccgggcgttttgctggtggacatcggcgttgcgcaaacactgctcgaacaacctgggcaactgtcgcggctattgttacctaagggtttccaaggtgaactgccggattccttcaaaggccagttgcaactcaaaagcagcggcgaagaaaacaatctggcacgcctgaccgagagctttcacctcaatctggatgccttgggttttctctcgtttctggtcggattgttcatcgtccacgccgctatcgggctggcgcttgagcaacggcgcggtctgctgcgtacgttgcgcgcctgcggggtcagtgcgcggatgttgattgtttgcctgatcgttgagctgggtgtgctggcgctgatcggtggactattcggcgtgatcagcggctattggttggccagtgtcttgctgccggacgtcgccgccagcctgcgcggtttgtacggcgcggaagtggcggggcagttgcgtctgagcccttggtggtggttcagtggcatcggcttgagtctgctcggcgccttgctcgctggggccaacagtctattgcgtgctgcgcgtttgccgttgttggccgtggccgatccgcaagcctggcatcagcaatatgcgcgttggttgcggcgccagggttggctggcagcggggttgggattgattgcgttggcggccttgatctggggcgacagtctggccagcggttttgtcttgatggccggattgctactcggcgcggcgttggcgctgccggtgttgctcagtgcgatattgagtcagttgctcgggcgcagtcgctcattgctcggccagtggtttctcgccgattgccgtcagcaattgcccgcgttgagtctggcgctgatggcgttgctgctggccctcgctgccaatatcggcgccggcagcatgaccgccggttttcgtcagaccttcgatgactggctcgaacaacgcctgagcgccgagctgtacatcaacccgaccaacccggcgcagtcccgggaaatgtacagctggctcaagcagcagtcgaacgtcgcggcagtgctgcccaactggcaggtgtcggtgacgttgcagggctggccgacggaggtgttcggcgtgatcgatcatgcgcattatcgccagcactggccgttgctcgattccagcggcggtgatccgtgggggcatctggcgacggatgatgcggtgatgctcagcgagcaactcgcccgacgcctgaaactacatgctggcgaacacctgacgattcccacgccgaacggctcgtggtcgccacgcatcgtcggcatctacgccgattacggcaacccgaagggacacgtgatcgccaacgtcaatcacctgctgcgcggctggccgcaactgacgccgaatcgcttcaacctgcgcatcgacccgcaacatattccgccattgctgagcgcattgcaggcacggtttcagctggaggacagccgcatcgtcgatcaggcacggctcaaaggctggtcggttcaggtgttcgaacgcacttttgccgcgacggcagcgttgaacagtctgaccctcgcggtggcgggcgtggcgctgtttatcagcctgctgacccagagtcagagtcgcctcggccaactcgcaccgttgtgggcgctgggcgtgacgcgacggcagttgatgctgctcaatctgggacagacgtggttgctggcggtgctgacgctggtgttggcgttgccgctgggcatcgcgctggcgtggtgcctggatgcggtgatcaatgtgcaggcatttggctggcggctgccattgcgggtgttcccgtggcaattgctgcaactgatggggctggcgttgttggcgacgttactggcttcggcatggccgctgtattcgctgtgtcgcacgcaaccggctgatctgctgaggacgtttgcccatgaggattaagctcgttgtgctgatggttttgttgctgctcggtggttgcgatcaatcggtgccggagcagaaaggcttcgccgggatgggcgatcaggcgttggcgtttacgccggtggtgccgggccgcgtgttcagttttccggcggatcacggcgcgcacgatggctttcgcatcgagtggtggtacatcaccgccaacctgaaggacgcgcagggcaacgagttcggcgtgcagtggactctgtttcgcagtgcgctgaaaccgctggcggagcaggccggctgggccaatcagacgatctggctggggcatgcggcggtgacctccgcgtcggtgcatcacgccgctgaacgttatgcgcggggcggcgtggggcaggccggcgtgcggctggcaccgttcgaggcgtggatcgacgattggcgctttgccagtcaggcgcaggatccgttgagcgacctgcagctcagcgcacgcgacaaggatttcgcctatcaactgcacctcacttccagccgcccattggtgttgcagggggagaagggtttcagccagaaatccgaagaaggtcaggcttcgtattactacagtcagccgtttttccaggccagcggaacattgcagatcgacggccagacctacaccgtcagcggccccgcgtggctcgatcgcgaatggagcagccagccgctgaccgccaatcaaaccggttgggactggttttccctgcacctggacagcggcgaacacgtgatgctctatcgcatgcgtcagaaggacggcgcgccgtatctcaccggcacgtggatagccgccgatggccagacgcaaaccctgcgcagttcgcagatccggctcaccccgcaagacatcgccaacgtcgccggtcgggcgatgccagtgaaatggtcgatcagcatccccgacaaacacctcgacatcagcctcgacgcgctcaaccccaatgcgtggatgaacctgcgcatcccgtattgggagggcccggtgcacatcagcggcagtcatcccggccagggctatctggaaatgaccgggtactgaaaggtacccacgaatccccgtaggagctgccgaaggctgcgatcttttgatcttgttttttaaaagcaaaatcaaaagatcgcagccttcggcagctcctacaatggatcggtttgaacttgggttggtgtgttgtcctctacagaaaaatctgccgaggattagccatgagcgacgacctgaaacccccagacctgaattcctggcagcgcctgttcgacgaccagacctactggcagcaatcccccgacgcacattacttcgatctgcaacgcatcgccgacgacctgctcggccaaggcgccatcgaccttgagcaatggcagatcctgcgcgccaaggccgacgacctgcacaaggattcccccgccatcaacgtcgcccgtgaactcgacgaccccgaagcctgaggacaacccgatgaaaccgatcacccaaggcgaacaccccgacgaaccccgcccaccgggcgaaaccgaacgcgacaacgacgccctgcggcccaccgacccgaaacagcgtgaaaacaacggcaaaggcacgcccagcggcgaatccaccgcgcaggacaccgcaaaacaacagacctcctcgacacaaaccaaagccaagccctgaacagcgtctatgctcagtggcacgttcgtcgccgaagccaattcggcgccgggcgctgccattcatcacagggaaagtattgcttatgaagctcaacgcactggccaaggccatcaccctcgcaaccgtactgtccgccaccagcttcggcgccctggctgccgatattccgctgtctgccactgttgaagcagatcaggtcaccaccaaagtgatctccgtcgatgccgccaaccatcaggttgtgctcgaaggcgccgaaggcaagccggttcatgttcagctcagcgacaaggcgaaaaacctcgccaatctcaaggccggcgatcaggtcaacatcgaagtgcagcgttccgtcgccgcctacctcgacaccgatgtggataaaggtctgcctggcaccaccgaacgtaccggtgagctgcgtaaggccccgggcagtgataaccccggtggtgaagcgtaccgtcaggttcaggtgcaattgaaaatcaccaaaattgatttgaagacaaatcaggtgaccctgcaaaacccggcgggcgtatcgaaagtcctcgacgtgaaaaagcctgaaattcaagccaaactgaaagatttgaaagaagggcagagcgtcatcgtcacttacaccgatatcttaaaagtgaccagtcaacacgaaagttgagcattaactctacaggatgattgttcttgtacaggtttaggtatgagaacaatcatataaaagtgtgttgtcggaagtttctcggtaaatatcggcgatacacactttttaactttctagtacataaatttcatctttatcaatgacgacataagcgccaacttctattaaaatcccctccgttcgcccagtgtcagggctctttaccggtgcatggattgccaggccattacactgggcgaacaccttcaggaagtggttgtatacaaattctgcaaacaaaaagggcgactctaaagtcgccctttttgtttgtgctgattttaagcatcccggcctacgctcgctggccctgaaagcgcttaagcgacgcctgatacatcttcgtgcggcggtgatccttgccgtaagtgcctgctgccgcaacggtgccggactggatgtgatccagataatggaaaatcttccgaggtgacaggaatttgatgccgtagcccagagccgacatccgatcctgcagtgtataacccggtacccgatcatccatgcagaagtgcagcccctgggacttcatcaaccgtgcattccacagagtgcagaaactcttcaggtgagtctctctatacggttttggctctttggttttcagccccaattgcgttttcgcccgtcgaacatagtgtttgcagaaacgcgaagttaaacgccaggtatcgcgcaacatcccgcgattgatttgctcgacacaaccgacggcggcgatgtccggtgtttttgtacactcgcgcatcatcatcgcaaacacttccttgtcgtaaacgaaagtgtcggtgtgcagcagaaacaggtagtcagtggcaactttgtccagcaccagatccagtgctttgccatgggcaatatgtccggcctctttacccggcgaaggccgctcgatcaaattgatccagtccagagaacgcaagtaatcgagactggcatccgccgaatcgttgtccactacccacacgggaatctgctgttccgtgacgtgctcgcgcaaaagctccaggcacatgcgggtcaagtccagggttttgtagttgaccaggaccagactgaaattggcctgcggtggggtgggcaaattaaaggcattcatgacagaagggctcatctgcgattcaagggcgacagggtttcgtggccgcgatcttagcgagacaaccttaggcgaaccttaatttgcggattgggtaaccggcagagtgtgtcgaattgagaccgctggtgtatgaaatgcatgcggtactggcaaccattaacggataaaatgcgtgccctatcacggttcaaggaagaaacggcagtcgccgttgtgtcacggatgaaaccactctccctctaccacccggccttgtattggctgcgcgtgtggcaaaaaagactgttccgccagattgcctggcgctgctccggcaaacgctacgctcgccccgtcgccacggccgagcgcctgccatatcgctacctcaaacacacctcgaaactcatccgcaaactcggcgactccgacctcgccctgcaacacaataaagtcatcaacctgaaactcgccgtcgccgccatcgacggcgtcatcatcgcccccggcgaacacttctccttctgccgcctcgtcggccgcccgactttgaaacgcggctacgttgaaggcatggaactgtctttcggcgaggcacgacgcggtgtcggcggcggcatctgccaactgagcaacctgattcactggatggccattcattcaccgctggtggtggtcgagcgctccaaccacagcttcgacccgtttccggatgaagggcgggtgctgccgtttgggtctggggcggcgattttctacaactacgttgatctggtgctgcataacccgacggatcggagctttcagctgaagttgaacgtcggcgagacacaactcgaaggggagttgttgtgtgatcgggtaagggagtatcgctatcacgtgtttcaagaggcgcatcggtttgtgcgggaaggcagcagggtgtttcgcgagaacgagatttggcgagaggtgcgggagaaggggcaggttggggaattggtggagcgggtgaggttgtatcggaatcgggtggtggttaagtacgacgtggcagatgagttgatcgggtagggcgcgtgaaagcacttcgctgacgatggcgccctttgatcagtttctgaaatacaactcatccagctggcgtctgcgtatcgagaggtactcctcccatatcttgggaaagtcctcatctttggttagagggaaggtcagataaatgtactttccaacaacgctgatgtattgcctcgcgcgtttgaaggccggctgctcgtaagctgcgacgctttcatcgtaggcgtcgtggtagtgacggatattcactcggtgtggtgcgatcatgcatcgcgaaaaatcgatcacccagcagctatcaacggccgtactcaaataaccgtaaacaccatcagtagaaagaagcaggcatgaatttgcctgggtgccgtcgtcatcgttgaccagaatgatctgatccgcgaagtaatgaatattcctgccgtccggcccttgcaaagacaagctccaaccttcggctcccatacggaattcaccgttgttatcaaaggttgctgtccatccattggctaaagtgatctgatgtttattcatgaggactggtcaagtattgatcgtgcggtggtgtgaggtagtcgcattaaatactgctcaaaggtgttcgaggtcaattagacagcctttgagttttaatcgcttgatctcatcattgaatttgtattttggcaagagttcgttttttatgtcgtaatgctgtctaagaaggcggaataatttccctatggtttttttgctgttttcgtcaaggctctcaaccaagtcgtaattattgtctgacagaaattcgattttgcttttaagtgtgtagtaagcgcttatgtttgaaagcaatccttccgcatctgaataatcttcttttaagtgttctgcataattttgaaatatagttgtcagcaggtgtcgtgctgcttttttgtgttttaaaactccgcacatttcctgccagttgctaatgaaaagatgatctccccagtcagagccgcgagcaaaatattttccattgcctttaaagaagtcagatgtttcatgaagttctaaagctgtttcaaaagtggtcgtcattgcggctttttccagttgtgaggatttcaacgagtctcaatattattcaggggcagaccacgttaactagagaaaagaggacagatttattttcagttagtagaaaataaatctgttctctttttgtcttctgcctgctggtgtaataccgaactcgagttggtcaaaataatattatatctacgttgccaatgtgtgctgttaatttttcacggaaatccgtttcgctggtgaagttagtgttgtcaatcatgttgaggaaccaagtcgcgtctaaagctgtaaatatttcaagccattcttgtcttttagccttcgattcaggcatgtcgttcgcggcaaagccgtggcctttgccttcggataagtaaaaatagttatctgcgaaggagtagcctataagctttggccagtttgagctatgcgggaggtttggctccatatacttactagcaatcacataaaaagttctcattttttttggaagtacgtcgagtttgtcgaagtttactttttgcccatctagatggagttgttgtgctccgccatcgccatattttctagattaccttcagaaaaagaaaacgtggtttgtccctcgttacggtgcaattacccatataggaagggtgtcgtcgggtgcttttctttgacatcgacgaggctagtcacgagcatttaaggttgaagggtaaaggtcatccgatgggcacttaggaaagtaaaaatttcaatctttatcggttgcgtctcatgtgtcctaatcttgatatttaaactgacctcgatatgtaaattcgatgcctcgtaatatggaagttgtggtttttcctttataagcacaattgtaaattgcaataacagtgtttattttttttcaggtgaagtagcgaggtttttctttttatttcagcgatgatatcggagtcataagaaaaatcctcgattgctttttccaaatttttagttggctctacgaaatcagcttcaataaagtcgtcgtcaataaagcccagagaaaatgcattgctgaactccgatcctagagattctccatcgtcagaataggcaggcgtcactatttcccgaagagtggattgctgccagtcggcgtttgcagtccaaattgatactgtttttttattactcatctttttctcctcaatttttaaggccggatgggagagagtcaactccaccttctaacctccgacccgcccactcattgaggtcctgtcggaactcgccgtaatctttcgaattgtcaattattttaagtatttcattatgtgcttttgtggaccctttgcccccatgatgaccagtagggttcacaaatttcacttcagcaatcgcggtccgtagctcatagatctgctcagcagaaaaggggacagatttattttcagcttgtagaaaataaatctctccccttttctgtttttttgtcattgcaattgtagtttttctcctttgagttgtagatttgattttctaaattttctgaactggatacgtgtcgcccgtgattgtaattgatcttccatctgattttatgtcttcgatgctgttaataaccaccttaagctctcttgagttggggaataagaagtaaaaaagctcgaagtagagataatcttttataaggctggcagccaaattgtgatggtcgtttaaaatttcattaaaggttggataacctattttttttagttcgggaatgtcagcgtagccttgctcagagtcatcaattttgcattcgacaataaatgagtttgcatggttgatgaagttttccgggaactcatcgttgtttatcgtcatttcgtatttttttgtttcgagaattgatttctcaccgaagccaaggctcctgtaagtgaccgtgtttagattgacttctgtgccggctgatttaaatatcatggaaattctccaggtggtattagcgtgatcgtaccatcctctttacgagaaaaggggacggatttatttgagtggaaaagggggcaagcagaaaaggggacagatttattttcagtgtgtcgaaaataaatttgtccccttttgtctggtgctgaccagcaggattcataaattttacatcggaaattgcaatgggtacctcacgcatctagaatatataatgtggaatgcctcgactgcttactagataactcacggttgaaagttaagttctgagtttgacgtattcctcaaagaatgaatagaagttttccgctattttcttagacggtttgcgcttaaatagatcgtagctaatgacctgtccatttttcgtggggccgcaatcaattgcccagcaaacttcgtcgtcttttaaataaatgacggcaaaatgactaggtaattcgaactctgaacggcagtacatggtgctgtaatttacagttccgccgttatctagagttgcatcattattctcaattccgcatatttctaagtctgctgcaccaccaccgcatacactcaagaagtcaacgaaatcttcaggcagctttatgcctagaatgttctcgagttttttaatttgctcggcagtggcgggtccgagccaaaatgtttcttcgtcggagttatcgagtttcgttatcaagtcttggtatttatgcatggttctgcttgctcaaggagaaaaggggatagattcatagtacaaatggatgaagtgcggagtgctttgggtcatctcgatccgacccagtgattttggtgaggacgacgccaaggcgtagaggtttttaaccggcagccaaattcgtgcgtcgttgcggtagaggtcccggttacgcactcgacccacgtaataccagccttgcgcctcgacggcattgatccatggccggcgaaaacctgcatcagctacaaggaccggaatgcagtctttggggagcatttcggccaacgtttgcagcagccgtttttgatatttcggacaaccttcgcgctcatgaacgctctcgtaaatcgggaacgaacgtcctgccagaggaatggctgcacgcaacaaaaagaactctccagccgcattgatcagtgaccaatcgactaggatcaacggatgtctcagcgaccccagcaaggctagcaacatgacccagtaaaacagcgaacgctcagtttgcagatgccgactacccagcaaccgatcgactcgtttgatggcgtgtttggggtaggccttgcctgacatgaatcgaccaagccccgtcagagtgagccgacgtccttggagtaatgcgctgacacaacacatcgtctgttttcagacgacgaaaatggacagtgggaagtgcttgggcgagcgcgctgtgtaagaatcggatggcctgcatgggatcgggatcttgtttttgtgtggtgcaatacaagctgccgacccatgcaggccacttcaattcctaacttcttgatttactgtaagaaaaatcggggatttctcagactccgtcccctttttcctttttccttaattgttttaatcatgatttaaaataaagcattgatgctgcttgcgattttagttgattttttagttggatagtgcggtttcagcaaggaagctgagcatgttttcgtactttgttttttgccatttttcagtttcgtgatcgaaaaaatatacctctggaaggcattggctatctttaatttcaaatccataaaaatcaccagttccattttcggaaaatagtatatgggttcctctggttgttgattcggatttatttatctctaaaatattgaagttgctgttttcatccagagagtagacgattccgaatgcgaaatatccgccgccaaatcgcttcgcaaactgtacgtattcaataggcagcattgcgttcagtgtattttgagcgaaaatcacactgtcttcgcttgctaggctgtctggctccaagccaaaccatactgggttggccatttttttttcgtttacaagttcttcaaattcggaaaaattcattttttgcgaccttgattgtcataaatccattctggcagcttttcatctgcgccttgttctctcgcacgataccaccagtgaagatttcgatcctgctgcctcatttctagagttacaccctgattgaacttattagggtgaagtgctttgttaccgcgatgctccgctggcaatatttcatggattgctgatccaggcatttgatccgcgtgatgaaggtcaggacttccaagtcctctcggcgggtggccaagcagtgcttgtttcaggtcatttgtagaccattcaccttcaatccttactgctggatcattagggccatagcccgtagaagtgggagcggcgggttctcctgtatcgactttggctttcgtaacgggatcttctacggatggaggaatttcgcatcctggtccccccggacagttatccagccccaacgggtccacccaccccgtagggttaggcacatactgatagttgttcaaaccacccgcaagcttgatcggatccggtgtcaaaaaccgtccggtgctgggattgtagtagcggtgccggttgtaatgtaatcccgtctcggcatcgaaatactgaccttggaagcgcagagggttgtcgatttcggcgatgtccaaggtggccagattgccataggcacggtatttcgccgaccacatgatttcgccgctgtagtcggtgagttcttgaggtgtgccgaggtggtcaagttggaaatagtacggggttgccttgacggggccttcgccgtcgagcatggccaatgggcggaagctgccaggctcgtagatgtaggtgcgatagctattctcggcactttcggcgatcaggcgttcaccttgccagagaaactctgtggtctgaccatcgacggtcttctcaatgcgacgaccaaaggcgtcgtacttgtagcttgcggtgctgccaccgggcagcgagacgccaatcaagcgatgctggcagtcgtagcggtattcggtgaccagttgctgtccggtaccacggcgttcgcgactaaggttgccgtaggcgtcgtagtcgtaatgccggtcgccttgcataagcaggcgattacctttgacgttggcgaggttcgcagttggcagatcgctttggccgagcaagttgccggccgggtcatgagcgaaggtttcgggggtggcgccgcgaacgctgaccagacgatccagtggatcatagtggtagctgcggtttcctttgcggctgtcatcgatgccggccaggttgccgtttgcatcgtaggcgtagcggcgctggaacagattgcgattctgctgacctacggtgtgcgcttgaagccttccctgttcgtcgtactgattttggctgagcagcacgccttgttggcgctgctgttcacggccagcgtcgaactggtgcgtagtcaggcgcgacccgttgaggtcgatgctgctcagccgaccgccggacaagtggcggtaatcgagtgtgctgccatccggcaggcggcagtgattgagttggccgacgctgtcgtattcgtaacgcgtggtgccccagccctgatgctcggtgatcagtcgatcctgcacatcatattcataagcaagcggccaatgaccatcgtccacattgaccagacggccaagtgcatcgtagctgtagtgaatttcctcgccgtcgggcagggttttgaccagcaggcgaccagaggcatcgcgctgatactcggtcaccaattcactgccgtcgtcaccaaactcggttttcttcaacagtttgccgttgaggtcgtactcgtaagcggtacgacgcccgtcgaaaccggtttcctgctggaccagcccatttgagtagtaatcgagttgatagtgttcgccgcgttcgttttcgatgtcggtaagcagcaggcgtgcgttgtcgtagcgatagcgcagttggctgccgtccggattgatacgacggctgaccagatggagattgtcggcgtactcatagcgagtgatgcgccccagttcgtcgcgttctgcagtgacgcggccgtatgggttgtaggtgaacgcacgggtagcgccgccgggcagggtgatctgtgccagacggttagcagcatcccactggtagtgcgaagaaaggggacaaatttattttctaaaaaaagggctggtttctcttgagtgcagcaaatgaaactgtctcattttcagttgaacttttataatttttattattgtaatgataagcggtaaataggcctaaagttttcgggagtggtgttttttacgaaagatctattttacgcctgcgtaaatattaaggtttttttattttattcagagtgtgatctaacgctctttcaagttcagtccaagttttcgcgctttcgctgtgcgtgggcgactcccagttttgatctgaaattagcgagattctaaaggagccattttcgctgaattctgggtaccatccaatatcaattatttgttcgagtggcagtgatgcctgtaatagatcttcttttaaatcgtcggtaataagtttgatgtcgcttccaactaatgtggagagatcatcgaaagtaattgttccgccgagcgttattattttatcaatgttcatcgattattttttcttcttggttagttttttgaaggcttcttcagatatcggatgtccatgtatggtgttcgcactcaattccaccctcatgtaccgggtttcttttccgtcgttagcaccgatagtttttcccatatcaatgactttccatggttttccattattgacatcttgtccgtttgcaaacgcgtgccgttctaatgcttctatatctgtgcccggcacatatttcgctgcacctccattggcagtggattttacgacagaaggccaaggagccttaggggccacatgtttatttccatggtttgtccattgaacgtctggaggaggcggggatccatcgctaaccttggctttttgctctggaggctcggcaccttggccaggaatgcacttatccccaccagggcaagtgtttagaccaagcggatccacccaccccgtagggttaggcacgtactggtagctattcaacccacccgcaagcttgatcggatccggcgtcaaaaaccgtccagttcccggattgtagtagcggtggcggttgtaatgtaaccccgtctccgcatcgaaatactgaccctggaaccgcaacgggttatcgatttcgttgacgtccagcgctacgaggttgccgtaggctcggtacttcgccgaccacatgatctcgccgctgtagtcggtgagttcctgcggtgtgccgaggtggtcgagttggtagtaaaacggggtggctttacgtgggccttcgccgtcgagcatggccaacggacggaagctgcccggttcatagatgtaactgcggtagcggttctcggcgctttcagcgatcaagcgctcgccttgccaaaggaattcggtgatgtggccgtcgacggttttttcgatacgtcgaccgaaggcatcgtaattgtagattgcagtgctgccacccggcaggctaacgccgatcaagcggtgctggcagtcgtaacgatactcggtgacgagtttctgtcctgtgccacggcgttcgcgactcaggttgccgtacgcgtcgtactcgtagtgacgatcaccctgcatcagcaggcggttgcctttgacgttggcgaggttggcggtgccttcattgctttggccaagcaagttgcccgccggatcgtgagcgaagctttccggagtagcaccgcgcacgctgatcagtcggtcgagcgggtcgtagtgatagctgcggttgcctttgcggctgtcatcgatgcccgcgagattgccattggcgtcgtagttataacggcgctggaacaggtttttgtcccgttggctgacgctgtgtgcttgcaggcgaccttgttcgtcgtattgatattggctgagcagcagaccttgctgacgctgttgttcgcgaccggcgctgaactgatgagaggtcaggcgcgagccattgaggtcgatgttgctcagttgcccgcccggttggtgacggtaatcgagtttgctgccgtcagggaggcggcagtgtttgagctgaccaacgctatcgtactcgtagcgcagggtgccccaaccttggtgttcttcgatgaggcggtcttgcaggtcgtatttgtaggcgagcggccagtggccgtcgtcgacgtttactaggcgaccgagggcgtcgtagctgtagtggatttcttcgccatcggccagggttttcaccagcagccgaccagcagcatcgcgctgatactcagtgaccagttcgctgccatcgtcgccgaactcggttttcttcagcagttggccgttgaggtcatactcgtaagccgtacgacgaccgtcgaaaccggtttcctgctggatcaggccgttggcgtagtaatcgaggtgatattgctcgccgcgctcgttttcgatttcagtcagcagcaaacgcgagttgtcgtagcgatagcgaagttggctgccgtcgggattgatgcggcgactgaccagatgcagattttcggcatattcgtaccgagtgatgcggccgagttcatcgcgttcagcggtgacattaccgtaagcgttataggtaaacgcacgggttgcaccgcccggtagcgtgacttgggcaagacgattggctgcgtcccattgatattgggtaatggcgccggattcttcctggcgggtgatctgccgacccagtgcgtcgtagcgatatttgcgctggccgccatcgggcaggcgttcttccagcaactggccgagattgttccagccgagttgatgacggctgccgtccgggtggcgaatctccagcagacgcccctggccgtcgtagctgtatagcgtggcattgccgtccgggtcgatttgttgggtgatatcgccctgacggttgcgttgatacttccaactggctttgccgcgatgcacatcgctgacgaaaccgttgatgtattcataggtggtggcttggtcttccggcgggatgacggctgtcatcaagccgttgtcgtcgtagcggtactcggtgacggcgcccaacggatccttttccgctatcaattggcctttgtcgttgtaggccttgagatgctcggcaccgtccgggtcgaccttgctgatcagtcgcgcctgatcatcgtgggtgtacacctcttcgctgccgtcggcgttggtgacagtcacgctgcctttgtcatcccaggcgtagtgcgcttccatctgcgagaagttggcccagtgacagatgcagcgagacagcttcccctcgttctcccactcccagtagaacgcagcgccgcccgccagttgccgctcgagaatgacgtgctgttcgttgtagcgatagcgctcggcttcgccggctgcgttctttgcttcgatcagacgatgctgggcgtcgtagctgtaggtcaccagcgtctgcactgtattccaggcgtcttccagattgtctgcgggcaggaactgctgatagtcgaccgcaacaatgtgtttgcggtcgtaacgtagaagcagggcgcgaccggcgccgttgtcgaggcgtttgatacgaccatggatatcgcgtgtgacgtgcagtcgattgccatagctgtcgctgatggcgattagggtggtgcctttgctgttgaaacggaagtgatagaacgacggacgcttgccggcttgcgctagaattagttccgatggatcgtcaccgaggaaaatggcagcttttgaaaggctgttagtgatcgctggacgttgttcactcgggagcgggaacggcgttgcgcggttttcgtggtcagtccagatgacttcatcgccattgatgtcaatgcgatgagccagtgcatggctccagccataacccagaccgcaatcaatttccacggcactggttctgtagagacgcgtccactcaaacggcagtagcccgtcgagttgaccgtcggtcagcgtcaacagctcttcgccggtcaccatcgaaaccgggcatccgttagtgcaagtctcggcggcaggttctgcacttttgtcggccggcgtcttcgcctgcttggaagcatcgtcagctattttgccatccgcgagtttcgcgtttttcttcccatcaaaccgcaactcggaaatgccatttctcaccttggccgtcacaccacgcgccgcaacagcggtgtatttcgcgacgtattccataaagccattgatgatcttgaacagcgacttcacaaagccgatgacggcgttgaggacaagctcaccgtacttcttcagacgggcggcaaggtagataaccccggtaccttcagccgcgatggtcaataccacaccaatcacgatatcgatggcgataccgacgaccattgccgtggtggttttcgctatgtcgcccgccatcttcatcggcggcaagcccgccagccagatcacggcgctgcgtactaacaggaacaaagcagcttcgtcactggccagcaacatggcctttttcataacgtccggcgagcttttggcaactttgatcagttcatccgcaccggcgccaagatctttcgcaaatttgcccgggtcctgcaggatgtcgagcacctgattgatgccatcccacacacccttgatggcctcccagccaccttcaagaatgccggtaccaatcgccattgcagtgcccgaggtggaaaggttcgaccattgcggtttgaaacctgcccactccttacgtagaaaaccttccaggtcagctgtcacgccgctgtaggagctgaacagcgcatcgatctgcgccggcgtcacttcgttatgaacgcgaatcttgtagaacttgccgggaataccacctgtccaggcggctttgccttgtgcgtcgagtttgaccttgctgactgcaccaccttccacggcgacaatttcgacttcgatatcgcctaccggaatgtcgtaaaccgactcgaatttactttcgatcagcaacggccccttgagcgggcactgcgccacgttcgaagtgaaattgccgtcggtcatgctcaccgctttgctcgagtcaccaaccttgattactcgctccatgcccagcagggaaggcatatcagcggcccgactggccttgtcggcgacgcgcgcgtaccaggttttggtttgttcctgatacagcttcagactgtccttgaaggtgttcagttggttgtcaacaaaggcaacgcgatccatcagccttgctccagaatcaggtgatttaacagtgcttctttaaggtttttcggtgcgtccggacggcgcacgaaacggctgactttcagcttcaggttgttctcgggccaagcggtgtaaatgtccggtcggtcttcttccagccactgcatcaagttgctgatcagcgtcgtcggattttccttggccaagccgtccagtaacggcttcggcacctcccaccacggccaatccttcaccttcggcacaacccgcgtcccaacctccagcgactgcccattaatcagataccgctcaaacatcggcagtacttccccggccttctccccaagcccatgcagaatcgggtagatatgccgcccatcccaaaaccggaaaaacacctcggtcccatccggcatcttcacctgagtcaggctgcgcagatgttcgaacacttcgttcggctccgaacgcgataccgccagccaaccccagtcgagggcgtcggtttcagcgatccacggcaggaacgcggaattggctttgagctcggtgacgtagggcatcaccggttgccaggtggagtagggcgtgccgccccagatcggcaggagctgggcggtgggttcggtcaggtagagatttttcagcgcgtcggaatcactcgccgcgctaatgaccagatacaagcgctcgccagtctgcaacggctgttgcgccagccaatccttgggcgtaattcgatcagatggcacaggcacctgccttgcatttttcgcattcttcgcaaaacggcgcgttacgtttgagggtgttgatctgggccggggtcaggacctggccggccttgtcggcgtcggcctgtttcaggattccgggtatcagcggggcggcgccagtgccgctccctgggctgccgcctgagttcatgttgatcaccgggccgctcagggtcacgccgccggcgtcgatcttgatgaagctgccgccgccgatcagggtcagctctgcgccggcttccatcaccactttcatgccgctgctgagatgaatttcctggccagcgtcgatgaactgaccggtgccgattttgatgtgttggttcacgcccacggtgaggtggtcgttggcgcgggcttcgactttgcggtcttcgtagacggtatggtgttcttcggctttgaattcgctgtagctgttttgctcgacggtgtcgtggcgttcgttgccgacgcggattttctggtcgtgctcgatgttttcgtcccagtcgcgctgggcgtgcaggtagatctgttcctgaccttttttgtcttcgatgcgcagttcgttgtagccgcctccgcccatcgagctgagggtcttgaaggtgctgcgggtcttgttcgccggcagtggatagggaacggtgttttccttgtggtacaggcagccgctgatcagcggttgatcggggtcgccttcaaggaaggtgacgagcacttccatgccaatacgcgggatggcgatgccgccgtattgggcgccggcccaggcgctggagacgcgcagccagcagctggttttgtcgtcggcctggccttcgcggtcccagtggaactggactttgacgcggccgtactcgtcgcaatggatctcttcacctttcgggccggtgaccacggcgctctggctgccgaggatgcgcggtttcgggtggcgcaggggcgggcggttgggcacgtcccacggcgtggcctggaagcggttgcggtagccttggtggaagtcgtctttgagtgcggtggtgtcgctggtcaccgactcttcgagcacttgcggctgtttgccttcgtggtggacttcagtcagcagccagaggtcattccacttggctttcgggtgcgcggtcagggcgaggaagtggccgctgaccagcagtggctgatcgctcttgccttcggcgagctggaagtcgctgcggtggcgttcgagggcgcgtttggccaggtgcttgccgcgtctcctacaggggaatgcattccaaatgtaggagtgagcctgctcgcgatgaggccggcccaggcaacacaaaaaccaagggcataaaaaaaggccatccgaggatggccttcaaaaaactagagaggttttttacttacaccgccgcaaccgggcgcatgtaagagattggtgcggtactggcgtcttcgaacgtcaccacttcccaagcgtctgtctgctcaatcaacttgcgcagcagctggttgttcagtgcatgaccggacttgaagcctttgaactcaccaatcaggctgttacccaaaaggtacaggtcgccaatggcatcgaggatcttgtgcttgacgaattcgtcttcatagcgaaggccgtcttcgttcaacacgccatcggcatcgaccacgattgcgttttcaacgctgccgccgagtgcgaggttgtgcttgcgcaggtactcgatatcactcatgaaaccaaaggtacgggcgcggctgacttcttttacgaacgaagtgctggaaaaatccacgcttgcactttgggtgcggtcccggaataccgggtgatcgaaatcgatctcgaagctcaccttgaacccttcgaaagggacgaaagtggcgcgcttgtcgccgtcttccactgtcacttcacgcaggatgcggatgaatttcttggcggcgtcctgttcttccaggcctgccgattgaatcaggaatacgaagggtccagcgctgccatccatgatcgggacttcggacgcggagagctcgacgtaggcgttatcgatgcccaggccagccatggccgagagcaagtgctctaccgtgtccactttcacgtcgccattgatcagcgtcgtcgacatagtggtttcaccgacgttttccgcgcgggcaggaatctgcaccacagggtcgaggtcagcgcgacaaaacacaatgccagtgtcgacaggcgcaggcttgagggtcagatagaccttctcaccggagtgcaggcctacacctgtggcacggataatatttttcagtgtgcgttgtttaatcatggcttgggccgcttcagcgcaaattgcgaactggtatcaacaaaggctggcgatgatagcagaccatgcctttgctgaacaccaatcaccttcatagccctgatacattccatcaatcggcctgacgacgcaggaatgccgggatgtccaggtagtccagatcatcttgcggattcatcttcgcggcagccgcagcaccggcctgagcctggttgcgcatgacggtcggacggtccagatcacggtagttgaccgctggcgcttcctgacgggccgcagccggttgttgcacctgagcggaagccatggaagtgtgaacggtgttgtcgatgaccttcacaggcttctcgattttcgcgcccagaccggtggcaaccacagtcacgtgcagctcgtcgcgcatgtccggatcgataacggtaccgaccttgaccatcgcgtgctcggaagcgaaggcttcgatgatcgaacccacgtcggagtactcacccagagacaggtcaggaccggcggtgatgttcaccaggatgccgcgtgcgccttgcaggttcacgtcttccagcaacgggttgcggatcgccgcttcggtggcttcacgtgcacggttcggaccgctggcgcagccagtgcccatcatcgccatgcccatttcgctcatcacggtacgcacgtcggcgaagtcgacgttgatcatgcccggacgcttgatgatgtcggagataccgcgaacggcaccggccagtacatcgtcagccttggcgaaagccgacagaaggctggcgtctttaccgaggatggtcagcagcttctcgttgggaatggtgatcaacgagtcgacgctttccgagagcatgcggatgccctcatcggcgatctgcatacgcttacggccttcgaacgggaacggacgcgtcacgaccgcaacggtcagaatgcccatttccttggccacttcggcgatgatcggcgcagcaccggtaccggtaccgccgcccatgccagtggtgatgaacaccatgttggtgccctgcaggacttcggcaatgcgctcacggtcttcgagagcggcctgacgacctacttcagggttggcgccggcgcccagacctttggtcacgccggtgcccagttgcagaatggtacgcgcgccgatgtttttcagcgcttgagcatcagtgttggcgcagatgaattcaacgccttcgatgttgctcttgaccatgtgattgacagcgttgccgccgccaccgccaacaccgataactttgattaccgggcttgcggggatgttgtctacgagttcgaacattttccctctccttacattctctagttttttcgcctactgctgtttgttgcggtgctgcggtaaagctttagaagttgccttgaacccacttcttcaatcggtccagcaacggcgcctgtggctcttcgttgctgtagctgtcgcggctgccgatgcccgagaacgagatcccgtcggactgcttttgcaggccgtacatcaacaagccaacgccagtggaataaatcggattgcgcaccacgtcatccagacctttgacgccgtgcggcacgcccagacgaaccggcatgtggaagatttcttcggccagttcagtggcaccttccatcttcgaggtaccgccggtgaggacgatgccggccgggatcaggtcttcgtagccgctgcgacgcagctcggcctgaatcagcgtgaacagttcgtcgtaacgcggctcgaccacttcagccagggcctgacgcgacagttcacgcggtggacggtcgcccacgctcggcaccttgatggtttcaccggcaccggccagtttggccagggcgcaggcgtaacggatcttgatctcttcggcgtactgggtcggggtgcgcaacgccatggcgatgtcgttggtcacctgatcaccggcaatcgggatcaccgcggtgtgacggatcgcgccttcggtgaagatcgcgatatcggtggtgccgccgccgatgtcgaccaggcacacgcccagttctttctcgtcgtcggtcagtaccgagtaggccgaggccagttgctcgagaatgatgtcgtcgatttccagaccgcagcgacgcacgcatttttcaatgttctgtgcggcgttgacggcgcaggtgaccacgtgaaccttggcttccagacgtacgccggacatgcccagtggctcacgaacgccttcctggttatcgatcacgtaatcctgcggcagggtgtgcagcacgcgctggtcagccggtatcgccacagcctgagcagcgtcgagcacgcgctccaggtcggccgagctgacttcgcgatcacggatcgcgacgatgccgtgggagttcaggctgcggatgtgattgcccgccacgccgacgaacgccgagtgaatgcggcagcccgccatcagttgggcttcttcgatcgcacgctggatcgattgcacggtggactcgatgttcaccaccacgcccttcttcaggccacgggacggatgggtaccgatcccgacgatttccagcgagccgtcgtcggagacctcgccgaccagcgccaccaccttggaggtgccgatatcgagaccgacgatcattttgccgctttgcacgtttgccatgggtcctgcctcttcttaattctttgcgacagcgggttgggctgtcgtcggcgctacaggttcccgccagccaacagcgaggccgttggcgtagcgcagatcgatgcgcgcaatgttcgtaatctggtctttaagcgtcttgtcatagatggcgatgaagcggcgcatcttttccaccaggttgccgcgtcccagcagcagctcgatgccggggccggaactgccggcaccggtggtcaggaaccagctcccgcgttcacgcaattccaggcgcgcaatcgagaagcccaacggccgcagcatctggctcagcacctggtactgctgcatcacttgctgctgggcccgttgtgggccgaacagctggggcaggtgttcgtagttcgccagttccttgggcgtaaacgcctggccctggttgttgagcaacgactcgtcgccccaacgcgccaccggcagttgctcttcgaggcggatcaccacctggtccggccatacccgacgcacttcggcgtgggcgatccagggcatctgctcaagctcggtgcgcatcccggcgaggtcgatggtgaagaagctcgacgccacgtacggggcgattcgttgctgcaccgcttgctgactgatgtagctcaggtcgccctgcacggcgatcttggtgatcggccggtcggcgtacgggagcaaacgcgttgcgccttcgtacgtaccaaaacccagcacgaccagcagcaccggccagaacagacttttcacgaagccgaaattggctttcggcaggcgcgcggacatcggctctttcgccaccatgcggctggcaccccgcggcaccggcttgcggccgggtgcgggaggctgatgtcggagctgagcgccttgcatcgtcttaacctcgagcgtcttcaacactggcggccagaatggccagaaccagttgctggaaatccagaccggcagcacgggccgccattggcaccagactgtgatcggtcatgcccggtgcggtgttcacttccaggaaccagaactgcccgtcggcgtcctgcatcacgtccgccctgccccaaccggcaatacccagcgcctcacaggccttggccgtgagatccatgagttgctgttccttggcggcatccagcccgcacggaatgcggtactgggtatcgttggcgatgtacttggcgtcgtagtcgtagaacgtgtgcggtgtacccagggcgataggaggcaacacctggtcacgcagggtggcgatggtgaactccggaccttgaatccattgctcaaccaagacttgcgaatcgtaggtactggccgctttccatgcgtcgatcaactcggacgcagaactcactttggccatcccgatacttgaaccttcatgcgccggtttgacgatcaaagggaagcccagttccgtcgctgccgaaatacaatcggcttcgctgcacagcacggcgtgacgtggcgtcggaatcccgaggctgtgccagacctgcttggtgcgcagtttgtccatcgccaatgccgaggccagaatgccactgccggtgtacggaatgcccgccacttcgagcaggccctgcatggagccgtcttcaccgccacgaccatggagaatgatgaacgcgcggtcgatcttttcgctgagcagacgttgcagaatgtcgtcgccaacgtcgatgccgaacgcgtccacgccagcgctttgcagtgcgtcgagcacggcgttaccggatttcagcgaaacctcacgctcggcactcaggccgccgaaaagcacggcgacgcggccgaagtccttcggcgcgatagtggaaaacagcttggcgtaggcagcagtcatttcaacttcccctcgaccgacgccgccacggcgccagcgaacaattcacttttcaacagcttcggcgcgaggccgccgatatcaccggcgccctgacacagcaggatgtcgccggcgcgcagcagcggcttgaccagtggcgccagatcgacgccacgctcgatatagatcgggtcgagctgaccgcgctgacggatgctgttgcacaacttgcggctgtcggcacccgggatcggctcttcgccggccggatagacttccatcagcagcaacacgttggcatcggccagtacattgacgaagtcgtcgtacagatcgcgggtgcggctgtaacggtgcggctggtagaccatcaccaggcggcgctccggccagccaccgcgtacggctttgatcaccgccgcgacttcggtcgggtggtgaccgtagtcgtcgaccagcatcacgttgccgccgtccaccggcagttcgccgtagacctggaagcgtcgaccgacaccctggaaacccgacaggccctgaacgatggcttcatcgctgacgccctcgtcggtggcgatgcaaatggtcgccagcgagttgagaacgttgtggttgccgggcatgttcaccgacacgtccagcggttcacgatccgggcgcagcacagtgaagaacgtctgcatgccttgctggcgaatgttgatcgcgcgtacgtcagcgtcttcgctgaagccgtaggtcacggtcggacgcttcaccagcggcaggatttcacgcaccaccggatcgtccaggcacatcaccgccaaaccgtagaacggcaggttgtgcaggaattcgacgaaggttttcttcagcttgttgaagtcaccgtcgtaggtcgccatgtggtcggcgtcgatgttggtcaccacagccaccagcggttgcagatgcaggaaactcgcatcgctttcatcggcttcagcgatcaggtaacggctggtgccgagttgggcattggtgcccgcggcattcagacggccaccgataacgaacgtcgggtccaggccaccggcggcgaacaccgaagcgatcaggctggtggtggtggttttgccgtgcgtaccggcgacggcgatgccgtggcgatagcgcatcagttcggcgagcatttccgcgcgcggcaccaccggaatacgacgctcaagcgcgttcgccacttccgggttcgaggtatttacagcgctcgacaccaccagcacgtcggcggcagcggcgttctcggcacggtggccgatgaaaatctgcgcgccgaacgattccagacgctcggtcaccggcgaagctttgaggtcggaaccggacacttcgtagcccaggttcaacaacacttcggcaatcccgcacatgcccacaccgccgatgccgacgaagtggatacgacggatgcggcgcatttccggttgcggcatggctttctgattctcaaccatgggccacctccagacaggtatcgaccacgctacgggtggcatcgggtttcgccagacggcgggccgcttgggccatatcttcgagtcgttgcggttgcatcaagacctctgtcaggcgcgcggcaaggtccgcggcaccagtcgttctttgcggcatcaggaaggcagcgccttcacgggccaaataatcggcgttgcgggtctggtgatcgtcgatcgcgtggggcaaaggcaccagcatcgagggcagaccggcggcagccagctcactgatggtcaacgcgccggcgcggcacaccaccaggtcagcccagccataggcctgggccatgtctttgatgaacggctgcacctgcgcatcaacgccggcggcgcggtagcgctctgcagtcacttcatcgtggtttttgccggcctgatgaaacacttccgggcgcaaatcggcagcgacttgggccagggcttcaggcagcaacttgttcaacggctctgcgccaaggcttccgccgaggatcagcaaacgcgctttgcgccctgccagagcaggtcgcgatgtgtcgaggaacagctcgctgcgcaccgggtttccggtggtacggcgggtgtccgacagagtaaaggtgtcggggaacgcttcacacactcgggcggcgaacggcaccagcaaccgattggcggtgccggccacggcgttctgctcgtgaacgatcacaggcacaccggccagtttcgcggcaaggccaccgggaccagtcacataaccaccgaagccgaccacacacaccggcttcaagcgacgaatgatcgcccgcgcctgccacaccgatttcagcagcatgaacggcgccttcagcagcgacagcttgcccttgccgcgcaggcccgtagcgttgatgcggtgcagttccagccctgcggccggcaccagttcgttttcaattccgcgtggcgtgccgagccagtgcacggtgtagccgcgcgcctgaaactcgcgggcacaggccagtgccgggaacacgtggccgccggttccgccggccatgatcaatacgttagcgcccatgattcggctcctcggcgaagtcgctctcatggaattccatctcttcactgcccaggtgggttcgactctcccactcgatcctcaataacaaaccgaggcaggcacagcagatcaccaacgagctgccgccgtaactgaggaacggcaacgtcagacctttggttggcagcaggccgacgttcaccccgatgttgatcaggaactgaccaatccacaggaacgacaagccgtaagccacatacgcggcgaagaactgtttggctttctctgcccacaagccgatgtacatgccgcgaatacacacgaacacgaacagcgcgacggtgcacagcgaacccactgcgccgagttcttcggccaataccgagaacacgaagtcggtgtgcgcttccggcaggtagaactgcttctgcacgctgttgcccagaccgacgcccagccattcaccgcgaccgaaggcgatcagggcttgcgacaactgatagccggcgccgaactggtcagcccacgggtcggcgaagttggtcagacgcgccatacgatatggctgcatctgaatcagcaagaccacggccccgaccgccaacaccaccatcagcgagaagcggaacaacccgaccccgccgaggaatagcatcgctgccgcagcgcccatcatcaccacggtggcaccgaagtccggctccatcagcaacaggccggccatcggcagcagcacgatgaatggcttgaagaagcccatccagctctcgcgcacttccttctgacgccgcaccagataaccggcgaggtagatcaccacgaacactttggcgatttccgacggctgcacgttgaagaagctgaaaccgatccagcgcatcgaaccgttcacttcacgcccgatgccggggatgatcaccatcaccagcaagccgaacgcaccgatcagcatcagccagccgaggcgctgccaggtggcgatcggaatcatcatggtgacgatgcacgcgcccaggcccagcaccacatagataaggtggcgaatcatgtaatacagcgggctgcccgactgcgcagctgccacttcagtggacgccgaggcaatcatgatcaggccaagacctagcagcgccaggcaaccggcgagcatcgggaaatcgaggtcgatgccgcgcccggtgatgatcggcgacggatacggcttgatgatattgaacaggctcatgccaggtcctccacagcgcggacgaactggtgaccacgatcttcatagttcttgaacatgtcgaaactggcgcaggccggcgacagcagcaccacatcacccggctgggcggcggcgcggcattgtgcgacggcgtcaaccagcgaggttgcgcgaatcagtggcacggcatcaccgatggccgcgccgatcttgtcggagtcgcggcccatcaggatcacggcgcggcagttggccgctaccggatcacgcagatcgttgaactcggcacccttgccatcaccgccagcgatcaaaacaaccttgccgtcgatgtccgcgccgaggccttcgatggccgccagtgcggcgccgacgttggtggctttggaatcgttgtagtacgccacgccgtcgagatcacgtacccactggcagcgatgttcgaggccggcaaaggtgcgcaaggccgcgagcatggcgtcgaacggcaagcccacggcatgccccagtgccaatgccgcgagggcgttggactggttatgggcgccgcgaatcttcagctcacgcaccggcatcaggttctggaattcgaaggccagatacttctcgccatcttcttcacggataccgaatgccttgaaatccggtttggtcaggccgaaggtccagcacggctggccctcgcccatcaacggacgggtcagcgcatcctgacggttgaccacgaactgcttcgcgccacggaaaatccggtgcttggccaggtggtacgccggcagaccgctgtagcgatccatgtggtcttcgctgatgttcagcacggtggccacttcagcgttgagctgatcggtggtttccagctggaagctcgacagctccatcacgtacagctcgacgtcgtcgctgagcaggtccagcgccggggtgccgaggttgccgccgacggcgacgcgtttgccggccgcagccgccatctcgccaaccagggtagtgacggtgcttttcgcgttggaaccgctgatggccactatcggcgcctgcgcgttacgcgcgaacagctcgatgtcaccggagagtttcacgccacgcgccgcagcggcttgcagggccggggtcgccagcgccaggccggggctcacgtagagctcgtcggcacggcacaggaattcgacgtccagctcgccacaacgcacttccacgtgcggatagtcacgcttgagcgtggccagttccggtggattttcccgcgtgtccgccacagcaaacgacgtgccccggttcgccagaaagcgaaccagggacatgccgctcttgccgaggccgacaacgatgcggaagtggtcagaagcgatcagagacactcgttctacctcagcttcagggtggcaaggccgatcagcacgagaatcacggtgatgatccagaaacggacgatcacgcgcggctcgggccagcccttgagttcaaaatggtggtgaatcggtgccatgcggaacacacggcgaccggtcagcttaaaggacgcaacctgaatgacgactgacagggtttccatcacgaacacgccgcccatgatgaacaggacgatttcctgacggacgatcacggcgatggtgcccagtgccgcgccgagtgccagcgcaccgacgtcacccatgaacacttgcgccggataggtgttgaaccacaggaaacccagaccggcaccgatcagcgcgccgcagaacacgatcagttcgcccgcgcccggcacgtagggaatcagcaggtactcagcgaatttcacgttacccgacaggtagcagaaaatgccgaggccaccgccaaccatcacggtcggcatgatcgccagaccgtcgagcccgtcagtcaggttgactgcgttgctcgaaccgacgatcacaaagtaagtcagcacgatgaagcccaggcccagcggaatgctgtaatccttgagcatcggcaggatcagcgtggtttccaccggggtggaagcagtcatataaaggaagatcgccgcgccgaggccgaacaccgactgccagaaatacttccagcggctcggcaaaccacgcgagttcttctcgatgactttgcggtaatcgtcgacccagccgatggcgccgaacaacagcgtcaccagcaaaacagtccagacgtagcggttgctcaggtcagcccaaagcagagtgctgacgccgatcgaagacagaatcagtgcgccgcccatggtcggtgtgcccgacttggacaggtgcgattgcgggccatcgttccgcacggattgaccgatctgacggttctgcagggtgcggatcatccacgggccatagcacagcgacaaaaccagcgcggtcagcacaccgaggatcccgcgcagggtcaggtactgaaagaccgcgaagcctttgtagaactgttgcagatactccgctagcagcagcagcattaatgtttctccagactggacccgcacagagccgcaacgatgttttccatcgctgcactgcgcgaacccttgatcaaaatggtggtgtttgtgtcctgctcggcgtcgagggcctgaatcagttcggcttggctgccgaagtgatgcgcctgttcaccgaaagcgtttacggcgtgaaccatgtttggcccaacggcataaagcgcggaaaccttgccacgggcgtactcgcccacgtcgcggtgcccctgctccgcccaatcgcccaactcgccgatatctccgagcaccaggacggtgcggccggaaaagccggcgagtatatcaacggcggcgcacatcgaggtggggtttgcgttgtaagtgtcatcgatcacgcgcataccgttcttcgccagttgcgcgacggtgcgccccttgaccggttgcacggcgccaagcccggtggcaatgccgaacagcgacacgcccaaggcgtgcgcggcagcggcggcggccatggaattggcgacgttgtgggtgccgagcaggttcagttgaacgcgttcgacaccttcaggtgtatgcaggttgaaggccgggcaaccacgggcatcggtgctcagatcgctggcgtagaagtccgcgtgcgtgttgctcagggcaaaagtcagcactttgcgcgcgcccgcacgggtcttccagataccgaaggccttgtcatcgaggttaagcacggcgacgccgtcggccgcgagcccgtcgatgatttcacctttggcttcaacgattttttccgggccgccaaactcaccgacgtgcgcggtgccggcattgttcaggatcgccacgtgcggtttggtcaggccaacggtgtaagcgatttcgccgagacgcgaggcacccagttcgatcaccgccgaggtgtgttccggcgccagttcgagcagggtcagcggtgcgccgaggtcgttgttcaggttgccacgggttgccaataccggaccgcgcgtgcgcaggatgctcgcgagcatttccttgacggtggtcttgccgctggaaccggtgatcgctgcgaccggctgagtgaatgcagcacggttcagcgcacccaactggccgagggcctgacgagtgtctttgaccagcaattgcggcaaggtgctgtcggcgacttcgcgctcgaccagcgcagccactgcgcctttggcagcaacgtcgttcaaatagtcatgaccgtcgaaacgcggaccggtcaacgcaataaacagttgcccaggctggatcgcgcgactgtcgatgctgacgccgtcgaaactggcatcaccagcgatcaaacgcgcatcgagggcgttggtcagttcgctgagtttcagggccttaagcatgggccacctcccaagcggtcagggcgtgatcagcctcgaccagatcggagaaagcgtggcgttcgccattgatttcctgatagtcctcgtgacctttaccggccaggacaaccacgtcgtcggcggacgcgccggcaatcagttgcgcaatcgcctggccacggccggcgacgaaggtgactttatccacagccgtaaaaccggcgcggatgtcgtcgaaaatcactgctggatcttcggtgcgcgggttgtcgtcagtgaccagtacctgatcggccaggcgctcgaccacttcggccatcaacggacgcttgccgcgatcacggtcgccgccgcagccgaacaggcacatcagctgacctttgacgtgcgggcgcaacgcggtcaggactttctccagcgcgtccggagtgtgggcgtaatcgaccaccaccaacggctgcgtgccgccaccgagacgctgcatgcgtccggccgggccttcgagtttcggcagtactttgagaatttcgtcgagcgcgtaatccagaccgagcaaggcgccgaccgcagccaggacgttgctcaggttgaaacggccgagcagagtgctgcgcacgaggtgttcgccctgcggcgtgaccagcgtggcgcgcacgccgtggtcgtcgaactgcgcttcgcggcaatacagataggcgctgctgtcgagcaggctataagtgatcaagcgcgactcacgtttttccgcggccagttgccggccgaaatcgtcgtcaaggttgaccacgcggcacttcaggtcattccaggcgaacagcttggctttggcctcggcgtacgcctccatgctgccgtgataatccaggtgatcgcgggacaggttggtcatcaccgccacgtcgaacgccagcgccgtgacgcggccctgatccagaccgtgggacgagacttccatggccacggctttggcgccggcctttttcaggtcacccagggtcgcttgcacggcgatcggattcggcgtggtgtgcagaccgctttccagcgcgccatagaagccggaaccgagggtgccgacgatgccgcaatgctgaccgagcagatccagcgcctgcgcaaccaattgggtcacgctggtcttgccgttggtgccggtcacgccgatcaggttcaagtgatggctcggctcgccgtaaaaacgcccggcgatgtccgacagctgtgccgccagacctttgaccggaatcagcggcacgtcagtgatcggcagcacggtggcgccttccacttcataagctacagccgccgcaccgcgttgcagcgcgtcggcaatgtgcgcacggccatcgaatttgccgccaggcacggcgaggaacagatcgcctgcgcgcacgttacggctgtccagcgccaattcacggatcaacagatcgtggccggcgtgggggaatatcttgttcagacttaatgacatcagccgcgccctccattggctttcagcggaacgaccggggtagcgttggcctgttgcgtggtcggcaggttgtccggggtcacgttcatcaggcgcagggtgccggacatcacgcggctgaacaccggcgccgataccagaccaccgaagtagccggccttggacggctcatcgatcaccacaacaatcgcgtaacgcggatcgctcatcgggccgaaaccggcgaacagcgagcgatacgagttttccgcgtagcccttggtgcccaccgatgttttacgtgcagtacccgacttgcccgccacgtgatacgccggcacttgcgcacggaacactccgcgcggtgcttcgatcacttgggtcagcatgccttgcatggttttcgccacggcttccggcagcacttgggtggtctgcggcatcttgtcggttttgatcagggtcagcggcgcgagacgaccgttgttggccagtgcagagaacgcgtgcaccagctggatcgcggtcacggaaataccgtagccgtaggacagcgtcgcggtttcggccttgcgccactcgcggtagttcggcaggttaccgacacgttcgcccgggaagccgaggccggtgtcctggccaagtccgactttctgcgcgaggcggaaaatggtttcgccgccgatatcgaaggcgaccttactcataccaacgttactggaattgatcagaatgccggtcaggtcgagcaccgggccttcagttctggatacgtctttgatcgtgtatttgccgatctgcagggaacccggatacacctcgacggtgtcgctcggtttccagcggccggtttcgatcgcggcgctcatcgagatggctttcatggtcgaacctggctcgaacacgtcgatcatcgcgcggttgcgcatcatcgccggttgcaggttgcgacggttgttcgggttgtaggtcggctggttgaccatggccagaatctcgccggtcttgacgtccatgatcaccagactgccggccttcgcgccgttctcgatgatcgcgttacgcagttcgcggttggccagatattgcagacgcaggtcaatggacaacgccaagggcttgccggccttggcgtttttggtgacctggacatccttgatcagccgaccgcgccgatccttgatgacctgccgtttgcccggcaccccggcgagccactcgtcataagccagctcgacaccttcacgaccgtggtcgtcgatatcggtaaacccgaccatgtgcgcggtgacctcaccggccggatagaagcggcggaattcctcgatgccgtagacgcccggcactttcaggtcgagcacagcctggccctgctcgggagtcaacccgcgcaccagataaatgaattctttgttggcctgggcctcgaggcgctcggtcagggctttcggatcctggcccagcgcggcggcgagtgccggccacttctctttcgccgtttgcatttccttggcgttggcccacagcgtggtcaccggggtactcacggccaaaggctcgccgttacggtcggtgatcagaccacggtgagccggaatcggaatgtgacgcagactgcgcgcgtcgccctgacctttgaggaagtcacggtcaaccacttgcaggtcaatgatgcgccagcagatcgccgcgaccatgatgccaagcagcgccaccatcaggcggaagcgccatgggaacagtgcgccttcgagtttcatcatggcgccaccatcttcacgtcagccgcgccaggaatatgcattttcagttgttcggtggccagcacttcgatgcggctgtgcgcggtccaggtgctctgttcgagaatcagacggccccactcggcctgcgccttgtcgcgcacgctgagttcgttataaagggtgttgagcaactgccggttccagtgcgcgctgtacgacacggcaatggccgagacgagcacgccgataaacagcagcagcatcagaaagctgccgccgggcagtggcttggcgaaaagcttgctcaccgcagcttctccgcgacgcgcatgacggcgctacgggaacgtgggttggctttgagttcggcgtcggaggccgtctgcgctttgccatggactttgattttcggttcgaacgcgacatggcgaaccggcaggttgcgcggcaggttgtcggcttcgcctttcaccagcttgcgcatgaacagtttgacgatgcggtcttccagcgagtggaagctgatcaccaccagacggccgccgatttccagagcgtccagcgcggcttcgaggccggcttccagatcacccagttcgttgttgacgtgaatacgcaaaccctggaaggcacgggtggccgggttcttgcccttctcccaggccgggttggcgactttcaatacttcggccagatcggcggtgcgctcgaacggcttgatatcgcgacgctcggcgacggcacgagccatgcgaccggagaaacgttcttcaccgtattccttgaacacccgggcgatttcctcagccggcgcggtgttgacgaattcggcagcgctgatgccacgggacggatccatgcgcatgtccagcgggccgtcattgaggaaactgaagccgcgttcagcgtcgtcgagctgcggcgacgacacgccgagatcgagcaggatgccgctgaccttgccgctcaggccttgctcggcaaccaccgaacccagctcggcaaagctgcgctgcacaacgacaaagcggccgtcttcggccgctagcgcttgcccggtggcaatcgcttgtgggtctttgtcgaatccgatgagccgaccgtccgtgccgagctggctgaggatcaatcggctgtgtccgccgcgcccgaacgtaccgtccagatagcagccatcaggacgtacggcgagagcctcgacggcttcgtcaagcagtacggtgatgtggttaaagccgctatcaatagtcacaggatcaaatcacgcagttcatcaggcatcgcgcccggttgttgaatggcagcaaggtcagcggcagaaaccgcgttccatgcatcctcgtcccacaattggaacttgttcagttggcctaccagcattgcgcgcttatcgagcttggcgtactcgcgcagacgcggtggaaccagaaaacggccactgccgtcgagttcgaggtcgacggcgttgccaatcaataaacgctgcaagcgacggttctcttcgcgaagcgaagggagtgcgcgcaacttggtttcaataatttcccactcgtcgagcggatagacacacagacacggatcaacggcatcaatggtcacgatcaattggccggaactgcgcgaatcgagctcgtcacggtaccggctcggcatggcgagacggccctttgcatcgagactgatagcgttagctccgcgaaacacgtctgcgtttctccaatttttatcgttttgagctcaaaaaacccacttcatgccactttccgccacttgcgcacactataggaatgcgcccaccacaccgtcaaggcgcggattaaaggaaaacccttacagaacggagatttaggagcataaaaggaggcgtaacgacaatctggcgcagactttcgacccataacttgatgcagcactggaagctgcgctcggaagttaaagtaatttgttaagagtaagattttttcggtattacaaaagcgcttctgctgttgattgaagcaaggtgggaaatggctattactgcgtttgccgctgccgaactttcagggcaggcctgctgatattacacagccctgttgcctttgattcaagcagggaaagaaaaaggtggagagtcgatctgtaagccgggttctgtcttgaacagtcattcgtctacgatggccatcactggacatctttagcaacctacccggtcccagcgcgggccacgccttgggaccctatttggtcttgctccaagtggggtttacctagccacgaactgttgccagacgtgcggtgcgctcttaccgcaccttttcacccttaccggcgccgaagcgcttaggcggttattttctgtggcactttccgtaggctcacgcctcccaggcattacctggcacttcgccctatggagcccggactttcctcccccccctaattttcatagagggcagcgactgtccgatcgactctccgccgcgaaggttaacggcagagcggccgaagaacaagcgctaatagccgcaaaacctgtctgcgcgacgggttactcgcccttctgtttatccagcgcgacctgatacagcacgtttttgcgctcgccagtgatctgcgcagccaaggcagcagcacgcttgagcggcatctcttcgagcaacagatcgagcacccgcatcgcctcgctgctgacggtgtcttcagactccggcgcggtccagcccgccaccagcacgacgcattcgccgcgctgctgattactgtcggattcaacaaatgcgcgcagctcagccaacggcaggcccttgagcgtctcgaaggttttagtgatttcacgggcaagcaatgcctgacgctcaccaccaaacacttcttccatatcctgcagacattcaagaatgcggtgcggggcttcatagaaaatcaaagtccgcggttcttctttaacagctgccagccgcgccttgcgtccgaccgacttggctggcaagaagccttcaaagataaaacgatcggacggcagccccgccgctgatagcgcagcaatcaatgcacaagcacccggcaccggcacaacattgatcccggcagcacgggcctgccgtaccaagtgataacccggatcggaaatcagcggcgtgccggcatcggagatcagcgcaacgttgtcgcccgccagcaaacgggtaataaagcgactaccttcatctcgttcgttatgttcgtgacacgcagccagcggcgtggcaatcccgaagtgctgcatcaggcgcgccgagtgacgagtgtcttcagcagcgatcaatgccacttcacggaggattttcagggcccgggcgctgatgtcgtccaggttgccgatgggcgtcgccaccacataaagcgagccagcagcggaattcagggaacctggagcagtcaaagcgcacacctcgtgatcggtaaaagcggccattgtagcgcgacacgaggcttgcgacgcgcttcgacccaccacggttttcctcgtggttacgcaccatcgcaacatttactacagctaaatcgttcgtttcacgccactaacatcgcgccccggccagtgcttgggtacaattcgacgctaatttgatcgagtatcaggaacacttacatgatcgcttgcctgcggctgttcactgccctctgcctcgctgccctgttggcggcttgcgccagctccccttcctccagccttggcgaacttccacggaccccggatgccagcatcgagcaactgctcgaacaggcgacccaggcgaaaaccccggaaaaagccgccctgttgcgcctcagcgcggcggatctggcttatcgccaaggcaacgccggacagtccgcgcaaatcctgcaacaagtgccgatggagcaactgaagccaggccagcagattttcgccagcacgctgaatgccgagctggccatgacccgcaatcagccgaaagccgcgctgactgccctgagccatccaagcctgcaacacttgggcgagatgcctgaagagcagcaagtgcgcaccggcaccgttcacgcccgcgcccttgaagccgacggtcagacgctcgcagccgctcgcgagcgcgtgttcatcgcgccgatgctgcaaggcgaagccgcgagcaagaaccacgaagcgatctggaccctgattggctcgctgccgtccgaccaactgcaaccgaacaccaccgacgatctcggcggctggatgggcctggcgctggcagtgaaatccgccggtacgctggaacagcagcaagccgcgatcgacacctggcgagcgcagaatccaaagcacccggcagcgatcaacctgccgctgccgctgaccaaactcaaggagctggccagccagcctctgagcaaaatcgccctgctgctgccgcaggacggccaactggccgccgttggcaaggcgctgcgtgaaggtttcatggctgcgcactatcaggcacaacaggccgggcagaagccaccagcgatcgagttctacgacagctcgaagctgacttcgatggacgagttctaccgcaaggctcaggctgacggcgtgcaactggtcgttggcccactggaaaaaccactggtcaaacaactgagcactcgcccgcaactgccgatcaccaccctcgcgctgaactacagcgaaggcgatcagggcccggcgcagctgttccagtttggtctggccgctgaagacgaagcccgcgaagtgtcgcgccgcgctcgtgccgatggcttgcaccgcgccgcgatcatggtgccgaaaggcgaatggggcgaccgtgtactgcgtgccttcagccaggactggcaagccaacggcggcagcattgttgccaccgaacgcgtcgatcagccggtgcaactggcccagcagatcgctgacatgttccagctgcgtcagagcgaagcccgcgccaagagcttgcagaacgccgctggcaccaacgtcgccgcacagccctcgcgtcgtcaggacatcgagttcatcttccttgccgccacgccgcaacaggcacaacagatcaaaccgaccctgaacttccagtacgccggtgacgttccggtttacgcaacctcgcacgtgtacagtgccagcggcgacgtgaaccagtacaacgacatgaacggcattcgcttctgcgaaactccatggctgctggacaccagcgacccactgcgtcagcaagtggttgcacagtggccgcaagccgctggcagcctcggccgcctgtacgcgatgggtgttgacgcctatcgcctggcaccgcgcctgggccaactcaaagccctgccggacagccgcatcgacggtgaatcgggcagcctcggcatgacccagacccaacgcgttgtgcgtcaattgccttgggcgcagttcgtcagcggccaggttcagcgcctgccggacaccccgcgctaatgcctgacaggtcacgctcgcagagcggcaaggatgccgagcgccaggcgctcgaacatctgcaaaaccaggggttgcagctgcttgcacagaactggttatgcaaacgcggcgagcttgatctggtcatgcttgatggcgatacagtagtattcgttgaagttcgctacagaaaaaacactcaatggggtggcgcgctcgctagcatcgatgagcgcaagcagcagaaactgattttcgctgcgcagtattttcttcagcgcgagtcgcgttgggccaattccccctgccgcttcgacgtggtggccatcgacagccatccggatcagctgaactggttgcagaatgctttcgacagttgatcgccggcgttgctacccggacaatcccaccgacaaattttgctctttgctttgcgggctgcacattcatgtgccgaatagccgcgctacttaaggtcacacagatggacatgcaatcccgaattcgccagcttttccaggccagtatcgacaccaagcaacaggcgatggacgtacttgcaccgcacatcgagcaagccagccagatcatggtcaacgccctgctcaacgaaggcaaaatgctctcgtgcggcaacggcggctcggccggcgacgcgcagcacttctcgtccgagctgctcaaccgcttcgagcgcgagcgcccgagcctgccggctatcgccctgactaccgacacgtcgacgatcacctcgatcgccaacgactacagctacaacgaagtgttctccaaacagatccgcgcgctcggtcagccaggcgatgtcctgctggcgatttcgaccagcggcaactcggcaaacattattcaagcgatccaggccgcacatgatcgcgaaatgattgtcgtagctttgaccggacgcgatggcggcggcatggcgtcgctgctgttgcccgaggacgtcgagattcgcgtaccggccaatgtcactgcacgtattcaagaagtccacttgctggcgatccattgcctttgcgatctgatcgacagccaactgttcgggagtgaagaatgacccctaatcgccttggccttctggccttgaccctgtgcctcggcatcagcggttgcacctcggtggtgaacgccagccgtgaagcaccgatcgatgacgatcgtggcacccgcaccttcggcagcaagatcgacgactcgttgatcgaaaccaaagtgggcgtaaacgtggccaaagccgacccggccctggacaacgattcgcacatcgtcgtcaccagtttcaacggtgttgtcttgctggccggccaaacgcctcgcgcagacttgaaagccaaggccgagcaagcggcagccgccgtgcaacgggtaaaaaccgttcacaacgaactgcaggtcataccgccgtccggtttcctggcgcgccagaacgacacctggctgacctccaagatcaagacgcagatgctcaccgacgccagcatccctggctcgcgcatcaaggtcgtgaccgagaacggcatcgtctacctgctgggcctgctgaccaaacaggaagccactcaggcgaccaacctggttcagggggtttccggggtgcagaagatcgtcaaactcttcgaatacatcgactgacacacaacgctgtgcaggagctgccgcaggctcctacagtttggcgatgcgcatgcagttttgagacgcgcatgaaaaaggcgatccatccggatcgcctttttttatttcaccactttcagacttggccggccgcttggacgcggtggctcactgtccggtggcggctgctcgtcacccagctcgatgtcgtcttcgtcatccatcggtgattcgagatcgaacaccatgccttgaccgttctcccgggcatagatgcccagaatcgcgctgatcggcacatacaagctgtgtggaacgccaccgaagcgaccttcaaaggtcaccacgtcgttgtccatgtgcagatgacgcacggcgctcggcgagatgttcaggacaatctgcccgtcactggcaaaaccctgcggcacctgcaccgccgggtattcggaattgaccagcatgtgcggggtgcaatcgttatcaacaatccactcgtagagcgcgcggaccagataaggtcgactggagttcatagcggctccttaagccttagcgcatatcgcgttcgacgccagacagactcgcctggaaagcctcacgcgcaaactggcgctccatgtaatcaagcagcggcttggctggccgcggcagttcaatacccagaatcggcaaacgccagagtattggcaataggcagcaatccaccagactttgttcctcactgaggaaaaatggcttgtcggcgaacagcggcgacacgcccgtcaggctttctcgcaattccttgcgcgccacgactcgcgcggcctccttgcttttcggatccaggatcagatccaccagaccacaccagtctcgctgaatacggtgaatcagcagacggctgttggcacgcgctaccggataaaccggcatcaatggcgggtgcgggtaacgctcatccagatattccatcaccacggtcgactcccacaacgccaggtcacgatcgaccagcgtcggcagactgccgtaagggttcacctcaatcagtttaggcggctgacgaccagcttccacataaatgatttcggcgctgacacccttctctgcaagcacgatgcgcactcggtgggaatagtggtcggcggggtcggagtaacaggccaaccgattggtcacgcccatggcgatcctcctcgcttgttgaatttgtcggaaccggaaaaacgcgcgcgcccagagggcgcctcccacaacacctggcgagccagatcttgtgttaccggaggcgcccttgggcgcgcgcgattaacagcaatgcttgaagcgtatcagtgcacgtctttccagtattcacgcttgagcaggtaggcgaacacaaagaagaacgccaggtacagcaagacataagtaccgatgcgctgatgttgcagcttaaccgggttagccgagtaagccaggaaggttaccagattcttgaccgtctcatcgaactgctctgcattctgagtaccggtcttcggcacgatggtcagctgatcacacgcttcatgggtcaaaggcgtgccggtcagcggatcgtattgctttttgccatcctcgacgatctgcacctgtttgcaacccacgacctgacgaccttgcaggccgaccagtacgttaggcatgccgacgttcgggaagaccttgttgttcacgccccatggacgcgcaggatcttcgtagaacgaatgcagataaccgtagagccagtcggtgccgcgcacgcgtgccaccagcgtcaggtccggtggcgccgcgccaaaccaggtcttggcgtcggctggctgcatgccaatgttcatgtgatcgccgattttcgcgccggtgaacaccagtttttccagcatcagttcgtgagggataccgaggtcatcggcaacccgctcgtaacgctggaacttggcactgtggcaacccatgcaatagttggcaaaggtacgcgcaccatcctgcaaggcagccttgtcggagacgtcaatgtcgaccttttccagctccggaccaccgtgttcagcggcgaaagacaagacaggcagagcagcaaaaatcagagcaaaaaataactttttcatcagccagtcaccctttccggaaccggtttggtcttctcgagccgggtgtagaacggcatcagaatgaagtaggcgaagtacaggaaggtgcagacctgcgacagcaaggttcgccccggagtcggcgcaagaacgccaagaatgccgagaataacgaacgaaatgcagaacaccaccagccagattttgctcatccagcctttgtagcgcatcgatttcaccgggctgcgatcgagccacggcagcacgaacagcaaggcaatcgaggcgcccatggcgataacacccatgagtttgtccggaatcgcacgcaggatggcgtagaacggcgtgaagtaccaaaccggggcaatgtgctcaggcgtcttgaacgggttagcttgctcgaagtttggtttttcgaggaagtagccgcccatttccgggaaaaagaacacgataaagcagaagataaacaagaacaccacaacaccgacaatgtccttcacggtgtagtacgggtggaaggcaatgccgtccagcgggataccgttttcgtctttgtgcttcttgatatcgacgccgtcagggttgttcgaacccacttcgtgcaacgccagaatgtgcaacaccaccagaccgagaatcacgattggcagcgcgacaacgtgcaaggcgaagaagcggttcaaggtgattccggagatcagatagtcaccacggatccactgcgtcaggtcgttaccgatgacgggaatcgcaccgaacagcgagatgatcacctgggcgccccagtaggacatctgaccccatggcagcaggtaacccatgaaggcttcggccatcagcgccaggtaaatcagcatgccgaagacccagaccagctcgcgcggtttctggtacgaaccgtaaagcagaccacggaacatgtgcagatacaccacgatgaagaacatcgaagcgccgacagcgtgcagcaggcgcaagatcgaaccgtgattgacgtcacgcatgatgccttcgacggacgcaaaagcctcttctgccgatggcgtgtagctcatcgtcagccagacaccggtgacgagctggttgaccagcaccagcagcgccagggagccgaagaagtagaagaagttgaagttttttggagcgtaatacttgctgagatggtcttcccacattttggtcgcaggaaagcgcgcatcaacccaatccatgaatttgctcatcacgctttctccgtatcgacgccaatgacaatcaggtcatcggtctcataggaatgcgggggaactggcaggttcaaaggcgcaggttgcgacttgtagacgcggccagccagatcgtagtgggagccgtggcaagggcagaaataaccaccgacccagtctttacccagatccgcaggtgccacttcgggacggaaggttggcgagcaacccaagtgtgtgcagatcccgatcagcaacagaatttccggcttgatcgagcgcacctcagggtcgacataggtgggttgcgtggagtttttggaagtcggatcggagagctggccctcgatcttcttgagattccccagaatttcctcggtacggcggacaatgaacaccggctggccgcgccactcagcaatcatctgctgtcctggctcgattttgctgacattcactttcaccggtgcaccagcggctttcgccttggcactgggaaaccatgaccccacgaacgggaccgcagcccccaccgctcctgcagcacccaccacggatgtggctgctaccaagaagcgacgccggcctgcattcacgccgtcattgctcattcagtcctctcccatcagcttttgtggcctgttaaatcaggcatctactaaataaatcaatgttacttataaaaattttgccgagatggtaatgaaaagccccaattctgacaagggaattacccggagctcataccctcaagccttgcagtatagggggtctacagaagtggcaagttgtcgcagcgcaattctttgataaatcgcaggcataaaaaaacgcccgcttccgtgaggaggcgggcgttctttttgaacgcgaaagcggaattaacgcttcgagtactgcggacgcttacgcgctttacgcagaccaactttcttacgttcaacttcacgggcgtcgcgagtaacgaagccagctttgcgcagagcgccacgcagggtttcgtcgtagtccatcagagcgcgagtgataccgtggcggattgcgccagcttgaccacttacaccaccgccgatcacggtgacgtagatgtcgaacttctcgacagtctcagtcagctccagcggctggcgaactaccatgcgggcagtttcacggccgaagaagttttccagcgaacggttgttgatggagatgttaccagtacccggacgcaggaaaacgcgtgcggttgcggtcttgcgacggccagtgccgtaattttgagtcgccgacataatgtactattccgttaaaacttcagttcttggggctgctgagcagtatgtgggtgtgcagcgcccgcatagactttcagcttacggtacatgtcgcgacccagtgggtttttaggcagcatgcctttaaccgcggtctcgatcacgcgctcaggggctttagcgatcagcttttcaaagttgatcgacttgatgccgcccgggaaaccggagtgggagtagtacattttgtcagtggttttagcaccggtaacacgaatctgctcagcgttgattacgacgatgtagtcgccggtgtcaacgtgaggagtgtactcaggcttgtgcttgccacgcagacggctcgcgatttcggtggccagacgacccagggtctgaccagcagcgtcgacgacaaaccagtcgcgctttactgtttccggtttagcagtaaaagttttcattctttatagcctcaggggccgccctgtaaattagacggcggatcttactgaatagtgcgtactttgacaagtcaaaggcagccggatacagacgctttcgggggctcgggtcggcgcgtccgttcaacggcaagattcttcggcggcggcgcatcacttccactgcagaaagaggtcggcaattatgcagattgcgaaaaatatttcaagctgcttttatgattgttttgcccaaggagcacccgatggactatcgccagctaggccgtaccgacctgaacgtgagtgcaatctgcctcggcaccatgacctggggcgagcaaaacactgaagctgaagccttcgcccagatcgaacgggccaagcaagccgggatcaatttcatcgacaccgccgagatgtacccggtgccgccaaaagccgaaacctacgccaccaccgagcgctacatcggcaattacttcaaaagtcgcggcgaccgcgccgactggattctcgccagcaagatcgcaggtccgggcaacaccatcgactacatccgcgacaagaacctgcgccacaaccgtcagcacatcactgaagccgtcgatgccagcctcaagcgcctgcagaccgattacatcgacctgtaccaattgcactggccagagcgcagcaccaattttttcggacagctgggctacaaacacaagatcgaagcgaacctgaccccgctcgaagacaccctcgaagcactcgacgagcaggtaaaggccggcaagatccgccacatcggcctgtccaacgaaacaccgtggggcaccatgcgttttctggccctcgccgaagcccgtggctggccgcgcgcggtgtcgatccagaacccgtacaacctgctcaaccgcagttttgaagtgggtctggcggaaatcgccatccgcgaacagtgcggcctcctcgcctattcgccgctggcgttcggtttcctgtcaggcaagtacgaaggtggcgctcgtccaccgaagggccgcctgagcctctacagccgcttcagtcgctatttcaatgcgcaatcggaagcagcgtgcagccgttatgtggcgctggcccgtgaacacggtctggatccggcgcaaatggcattggcgttcgtgacgcagcaaccgttcgtcaccagcaacatcattggggcgacgacgcttgagcaactggacagcaacatcgccagcttcgacctgaagctgtcggatgaagtgctggaagggattgaggcgattcacaaggatcatccgaatcctgcgccttgacccccccccttcccgtctgatcgttcccacgctccgcgtgggaatgcatcccgtgacgctccgcgtcacatccactgcggaacgcggagcgtccccggcggcatgcccacgcagagcgtgggaacgatcatcaaagcgaccgcgcaatgatctccttcatgatttcattggtgccggcatagatccgttgcacccgcgcatccgcccacgcccgggccaccgggtattcccacatgaagccgtagccaccatgcaattgcacgcactcgtcgagcaccttgcattgcaggtcggtgccccagtatttcgccatcgccgccgtcggtacgtcgagcttgccttgcaggtgcagctccagacacttatcgacgaagacccgaccgatctgaatctccgtggccatctcagccaatttgaatcgggtgttctgaaagtcggcaatcgccttgccaaaggctttgcgatcacgggtgtaatccagcgtccactgcaatgccgcttcggctgaagccagcccaccgatcgccacggtcaggcgctcctgcggcaattcctgcatcagataagcgaatccggccccagcctgacccaagaggttttccttcggcacacgcacgtcctggaagaacaattccgacgtatcctgggccttcattccgaccttctccaggcgtttgcccttctcgaagcccggcgtgttcgcttcgaccagaaacaggctggtgcccttggcgccggccttgggatcagtcttggcgacaacgatcaccaggtctgcgagaaaaccgttggtgataaaggttttcgagccgttgatcacatactcgtcaccgtccagcacagcggtggttttcacgccttgcagatcggaacccgcgcccggctcggtcatggcgatggccgtgaccatctcgcccgaaaccagtttcggcaggtatttgtgcttcagcgcttcgctgccgtaatgcaggatgtaaggcgcgacgatgtcggaatgcaacgagaagccgatgccggtcaggcccagccgaccgacctcttcgatcaccacggcgctgtagagaaagtccgcgcccagcccgccgtactcctccggaaggtgcgagcaaagcatccccgcctcccctgccttgttccacagcttgcggtcgatatggccttgtttctcccattgcgcgtgatacggcacggcctctttctcaaggaacgttcgtacgctgtcgcgaaacaattcgtgctcggagctgaacaaggttctggggatcatgcggcaccttactttattgttggaggattatggccttcagagactaagcctcccctctgacacaggacactggacacatccgacaaaaaataagacgatccagccgtctggtgaccactttcccttataaaaacaaaacaaaagttgaattatgtccaagcaagtctccacgcccttgcggcgcgtcagcatcctggcaatcgaccgggttttcgcttacaccctcatgcaggccaaggattttttccatgtggccagcctccgttacggcaaacaactgggccacggcctgacgccggcgtttgaaacacgaatcgtcagtcccgatggcaaaccggtgaaaagcttcagcgatgtcgtcatgccggtggatggtggtctggaaaacaccgatatcatcatcctcccggcgttctgggatgatttcgagaccttgtgcagccgttatccacagatcctgccttggctgcgcgagcaacatgcccgcggcgctgtgctatgcggcgaagccactggcgtgttctggctggccgaagccgggttgctcgatggcaaggaagcgacgacctactggcgtttcttcaatgcctttgccgaacgctttccgaaggtctacctcaatcaggacaagcacctgaccgacgccgataacctttactgcgccggcggcaccacatcggcctgcgacctctatatctacctgatcgagcgtttctgcggcgccaacgtggcgcaagccgtggcccgcgacattctctatgaggtgcagcgcagctatgcgccggggcgtatcggtttcggcgggcagaagctgcatcaggacgtgatcatcctgcagattcagcactggctcgaagagcatttcgccgacaagttccgcttcgaagacgtcgcccgcgagcatggcatgagcatccgcaatttcatgcggcgtttccagaccgccaccggtgacaagccgctgcattacttgcaacggctgcgcatcgagacggccaagggcttgttgtccggcagccgcaagagcatcaagaccatcagttatgaggtcggttacgacgacgcgagtttctttgcgcggttgtttcgccagcacacggagctgtcgccgaaccagtatcggcagcagtttcagcaagctgcgtaaccctccccacccccgatgatcgttcccacgctctgcgtgggaatgctgccaatggacgctccgcgtccgccccggaatgtgacgcagagcgtcacggtatgcattcccacgcggagcgtgggaacgatcagtgtgcgcgggccggtgaattcgagataaaaaagggcctgcaatcgcaggcccttttactttgccgattctgtttaaggcttgtgcgcccgcgacaggaactcgtgcgattgcatctccagcaatcggctcaacgtgcgctggaactcgaagttcaaacgtccgccggtgtacagatccttcagctcgacttcagcagaaatgatcagcttgacgttacggtcgtagaactcgtcgaccatgttgatgaagcggcgagcgatgtcgtcggtggtgacgctcatctgctcgacaccgctgagcagcacggcgtggaagatcttgcccagttcgatgtaatcgttctggctgcgcgggccgtcgcacagttcgcggaagtcgaaccacgccacgtcatcgcaagtacgcagggcgcggatctcgcggttttcgatgatcagtacatcgttctcgaccgcggcagtgcattccggcgtcagtgccttgaagctcttgcgcaggctttcgtgagcggcttcatcgagcggatagtggaacagctccgcttgttcgaggtgacgcagacggtagtcgacgccgctgtcgacgttgacgatctcggtgttctgcttgatcagcgcaatggctggcaagaagcgcgcacgctgcagaccgtccttgtacaggccatccgggacgatgttcgaggtcgcgaccagggtcacgccattcttgaacagctcttccatcagcgtgccgaggatcatcgcatcggtgatgtcagacacgaagaactcatcgaagcagattacccgcgactcggtcgcgaagcgcttggcgatgatggtcagcgggtttttctcgccgccgagggttttcatttcttcgtgcacgcgcttcatgaagcggtggaagtgggtgcgggtcttttccttgaacggcagcgcttcgaagaaggtgtcgaccaggtaagtcttgccgcgacctacgccgccccagaaatacaggcccttgaccggcgtctgatcttttttgccgaacagtttgctcagcagacccggcttgttctgatcggcggcgatcagatcctcgtacaaacgctgcaaatgacgcacagcagtttcctgcgcggcgtcatggaagaagtccgggcgtttcagatcagcttggtatcgttctaggggcgtcataattcgttagcaaggcaacaaaaacgggccgtcactgtagcgacggcccgtaggaatggcaatcggcccttggtcgggtcgtgccgccgattagtcctgaaccggggtcagcgcgacgcgcaaagcctcgatggccgcgtcccgcgcagcagcgtcggcgaacgccgggctgtcaccaacgcactcgccttccagccagacgctgaagctcaggtcttcgctgcgcacgtccagcggctgaccggattgcagttgcttggtcacctggcctgcggttttgccgtcggcgaagctgcgcgacagcagcagttgctcgccatcggctgccagcagacggaaacggaagctaccgtcgtcttcgcggaagctgacgaaacgcgcagctttcgcggctttcttcttggtggtcgcagcgacttgcacctgattgacgaaagaacgcaggccaacagcttcgcgcagttcgttgaggaacggcgttgccacggcgcgggccttcttggcaccgatctgcagaatgtcttccagatccgccgggcgctcgatcaactggtgatacttgtcgcgcgcttcgccgagatcgttgtcgagcaactggaacagacggttcttcgcctcgccccaacccagaccggccaacagttcgctgcggaattcgtcagcctgcgccggcgtggcgaaagcctggaacagcgtgaacaggtgcgaattgtccggatccttggcttcgcctggcgctttggagtcggtgacgatccgcgagatcgcgtccttcatctctttggcgctggagaacaacgggatggtgttgtcgtagctcttcgacatcttgcgaccgtcgaggcctggcaacgtcgccacgctttcttcgatcagcgcttcgggcatggtgaagaattctttgccctgaccgaacaagtggttgaaacgttggccgatgtcgcgggccatttccacgtgctggatctggtcacgaccgaccggcaccttgtgcgcgttgaacatcaaaatatccgcggccatcagcaccgggtagctgtagaggcccatggtgatgccggcgtccgggtcttcaccggtttcgacgtttttgtccaccgacgccttgtaggcgtgcgcgcggttgagcaggcccttggccgcgacgcaggtcagcagccaggtcagctcagggatttccgggatgtcggactggcggtagaaggtcacgcggtcgacatcgaggccaccggccagccaggtcgcggcgatttccagacgcgagcgctggatgcgcagcgggtcatcgcatttgatcagggcgtggtagtcggcaagaaagtagaacgagtcggcattgctgtcgcggctggcaaggatcgccgggcggatggcgccggcatagttgcccaggtgcggcgtgccggtggtggtgatgccggtgaggatacgggtacggttcgtcatgggtaatcgcttgtcagactgcaatcaattcgagagacgcggcaggatcagatccttgagatcggtcagcttgccatgaaaaaagtgtccgcattctgccactttcagcagctcatgggggcgctggagtttttccgaccagtcgtaaaccagttgcggatcgatgacttcgtcggtttccggctggatcaccgtgagttcgccgtgttgcggcagttgatcctgctcgccaagacgcatcaccgccggcgcgaccatgaacaggtgcttgagctgcacgccttgcgcttcgagacggccgccgagacttgctgcaacaaatccgccgaaggagaaaccgaacagggtcagcggtagatccgggtgtttctcgcgcagccatgcggcggcagcctgggcatcgtcgacttcaccggtgcccatgtcgtgggaaccttcactggcacccacgccgcgatagttgaagcgcaaggtgatcaggccggcgtcgcgcgcggtgcgctgcagggtcgagacgaccttgttgagcatggtgccgccctgcaccgggttcggatggcagatcagcgcgatgccgattggctgctcgttatccaggtacaacgcttcgatttggccgacggggccggcaatcactacaggggtttcacgcatcagcaaggaaggaactccgtgacctcgaatcgggtcgactcgtctagcaaattgtctgtgccaatctattgcgagtgaatcgcggtatacagcgcaggttcgagccgttaacgtaaagcaaagccgtttatagaggaaggactcgtggaacactcgctcttagtttggttgttaccgactcttgccctggttgtgggtgtcgccattggattcctgatcgcgcgcgttgcgccgaacgccgcaccgagccgtacgcagcgtcaactggatgatatccaggagcgtttcgacagttatcaaaacgaggtggtcacccacttcaacagcaccgcgatgctggtcaagaagctgacccagagctatcaggaagtgcaggatcatctcgccgagggtgccaatcgtctggccctggacgagcagacccgccagcgcctgatcgctgccctgcacgctgacgcggcgcaggcgccacgtgaacgcctgacgccaccgcgcgatcaggagccgccacgcgactacgcaccgaagacgccgaactcaccgggcatgctcgatgagcactatggcttgaagaagtaatcagtcttcgctgacaaacaaaaagcccccggacagtgatgtgtccgggggcttttttgtatctgatagttttgtgcggccgacttgatcgccatcgcgagcaggctcactcctacattttgaattgcattcccctgtaggagtgagcctgctcgcgatgaggccataacaggccagacaaaaaaatgcccgatcaccggatcgggcattcttcattcaggcaagcgcttatggatactgctgaacagtgcccggctgttgctgctgaccaccatattgctggcccggaatcgccttcaggttgacttcaacccgacggttctgcgcccggccattgacgtcgccgttgctggcaatcggattatccggaccggcaccacgggccgtcaggttggcaccgctgacgccttgcgaggtcaggtaggtcgccacgctctgcgcacgacgctgggacaggtccatgttgtgctggcggctgccggtgctgtcggtgtaaccgacgatctcgatctgattctggttgaactctttcagcgagttggccagattgttcagcggttgatagaagctggacgcgatgttcgccgagtcggtcgcgaaggtgatattgcctggcatgatcagcttgatctgatcgccctgacgctgcacttcaaccccggtgttggccatgctcgcgcgtagcttggcttcctgcttgtcagcgtaataaccgtaaccggccgccgaagcccccaccaccgccgcgccgatcaaggcacctttgccgcgattgttatggtcgatggcagcaccggccaaagcaccggccagcgcaccgagaccaccgtacttggcggttttgctcatgccttgagagccaccatcggcctggccctgattgtcatacggattaggcgaggcgcagccggacagcaaggccacggcggtagcgacaataatcaaacgacgcttggtgaacatggagagctcctacttttgcattctatgacggccatttttggcaatggacctgtgcgggcgttggatcatgacaatgcacaaaaattccgccgggcactcgtgacaaaatatttaggcccgcacaaaagggttctcgcgcatttcatcgcccaaccgtgtatccggaccgtgcccggtcaccactgttgcgtcttcgtccagggtatacagccgctgtttgatcgaacgcacgatggtcgcctgatcgccgccccacaaatccgtacgtcctacgccacgacgaaacagcgtgtcgccggcaatcaacagcttagcctcggaaaaccaaaagctcatggaaccgggggtatgtcccggcgtatgcagggccacgccgcaaccacaggccagttcttcatcatcgtttaaccagcgatctggcgatggcaccggagtgtatggcacaccgaacatctgacactgcatctcgaggttgtcccaaagaaactggtcttccttgtgcaaatgcagggtcgcgccggttttttccttcatctgcccggaagcaaggaaatgatcgaggtgcgcgtgggtgtggatgatgctgaccactttcaggccatgcgcatcgaggcgcgccatgatcaggtcagggttgccgcccgggtcgacgacaatggcttttttggtcagcgggtcgccgatgatcgtgcaattgcactgcaacgggccaacagggaaggtttcgcggatcagcgctggttttgcaacggtcatgggcaatcctgagccaaggttcgaagcggcagatcggcgattttaccgccgttagatcattaaccccagctccttggcccgcgccacggcttgggtgcgccgctcgacgcccagcttgctgttgatgtggctcgcatgggttttcaccgtgtgcagtgaaatgaacaactgctcgctgatctcctggttggaacaaccttgggcgataagtcgcagcaccgccagctcacgactgctgagctgttctgctgccggacactcgggcaccggacgggttgtagacggggcaatgtgttcgagcaattgctggccaaccgggttcgacacgttagccgccaattgcccgcgcacccagtccggatgttccttgagcaagccatcgaagggttgcagcacaccgcccgctgcggcatccagcgccaggctcaacgtcttgcgcgcttccggctcgcgaccaccggccagcagcaacgccactttctgcgtcaacgccatcacactgagcaactggcggccggtttgctggccgttttcatgcaacacgttcaaccgcccttcggcgagcatcggttgcccttgaatcatgtcgagcagtgcctgttgcagctcgacatgcaagggcaactgcggatgaaattccggtggcgcggcagcacgttcgccggtgtaggtctggcccagtcgcgccagccaggcttcggccagatcggtgcggccctgggccagccacagttcgcatttgaccagcgtgatcatcgccagatagtagatcggcggcacgtcccagatatgcatcagccgttcggcttcggccaattccgcaaaagcaccggcgaactcgcctttggcgccatccagccgggcgatcacacaatggccgatcaacacgctgatatcgcgacaggcgcgcgcctctgcgatcccggtcagcaggcgcccgcgcgcggcctggggttgcaggcgcatcgccagcagaaagccctcgtataacgtcagacgcgcacgtacggcgtacaaacgttgcgccgacaacccgcgcaagcgctccagcccttggtgtacttccgtgagcgcacggagaatttcacctcgcgattgcagaacccgcgcccggtcgtaatgcgccaatgcttcaaacaagggattgccgacccgctgcgccagctcaagggattcgcggttcaagccccgcgcgcgccacagatcgccatcggcaatggccagattcgacaaggtcgacaagcacatcaaccgctgaccgtagcgcttggccggcaggctttcgagcgcttcgctgcaatagcgcagcgtcaactctcgatgcccgcgtccgcgagcaatgattccgctgagtgccagccattgcgccagcatcgacttttgcgcggtggccgaaggcgccggcaggaaacggctcagatgactggacaactcttcggcggcatcgagctgacaggccagccccagcgcccagctgtagagcacgatcaagcgtggcgtgctgatcagcagactgtcgggcaaatccattttccagcgcagcaacatgccgatgttttgctcggcaagcagttgttcttcggagaggttctgcaccagattcgctgccacgtcgagatggccggcgcgcaaggcctgctccaccgcttcgtcgagcagcccctgcgcgttgaaccagcggcaggcgcgcagatgcagggtcgccggcggcaccatcgcctgcgcgatcggacgactgcgcagcaagtcggagaataaatggtgatagcgataccagtggccatgctcgtccagcggcaccagaaagacttggtgtgcgagcaggaaacgcaggatttcggcactgtcatgggcttcgcgcacagcatcgcagagttcgctgcaaaagcgctcctgtggcgccgtgtcgtagagaaatgcctgcacttcggccggcaaacaatcgatgacctcttccagcagatagtcgcggatcagcccttccccgccgttcaacgcttgcggcaacaccgcatcgctgccggcctcggccaccgccagcagccagaaacgcaaacccgcgacccagccttcgctgcgctgaatcaggctttccagggcttcaccgcgcagagacgtgctgtgccgatcgagcaggctcagtgcttcgtcgcgggtcaggcgcaaatcctgttcatgcaattcgagcaactgtcgcgacaggcgcaagcgcgccagatgccagtccggtcgctgtcggctggtaaccatgaccagcaggccatcgggcaaatgattgaggaagaattgcaggcaacggtcaagaaccgggccttgagcgagatggtaatcgtcgagcaacagcagcaacggcgccgccggatcaagttgcagcgccagttcgtcgagcaagccatcgagccattcctcgaaggcaaatggctgatgccgttggcgcattttcagcaggcccaacgcgcggctgcccaactgtggaaagtagtcctgcaggccttcgagcaagcgttcgagaaaccgccccgggtcgctgtcccgtgggctcagacccagccataaactttgccaatgcgctggcaggctctgacaaaactccactgccagcgagctcttgccaaacccggccggggcgctgaccagcaacagtcgcccaccgagcccggcttgcaggcgctcgcaaagtcgtggtcgcagcacgtatccgtcggggagtggcgggcgaaaaaaacgcccgtccaatgccgtgacggcaacacttgcgggacccggaagtggggacagatcagtcatggccggctcttgttcgaattgctgttggcggcgttgcagatgtccgcagactagccttaaacgaagagggaatgaaggttgctgctacaaatggctacaaaaaagctacacagcgccgacaaaaaccggcatcaccgctgcatcgcgcccccgatgaacccctgtaggagctgccgcaggctgcgattttttgacgttgttttgccctccccctgaaaaaaagcaggatcaaaagatcgcagcctgcggcagctcctgcacaagcagggaaatctgatcgaaaaaaaacgccccgaaccagtcggggcgtttttcacgaggatgcggcctcgggtttacagcggtttagcggacgccatcctgacgcagtgcggccggggtgaaatcgctggtggtagcagtgaagccgaagtcatatgcctgcttctcttcgttcttcatgcccagagccagataacggccggactgcaggtcgtagagggtttccagggcgtaccacggcacttgcttgtcgtagtagttctcggcatgcgcctcggccacacgccacagctgaccacgaccatcgtaatggtcgatcaccgcggcttgccaggtgtcttcgtcaatgtagaagtcacgcttggcgtagatgtggcgctgcccttccttcagggtcgcgaccacatgccagacgcggcgcagctcgtaacgcgccagatcctggttgatgtgaccggccttgatgatgtcagcgtatttcagcttcggatcgtcgagcttgtagctgtcggaggcgatgtacatctctttcttgccttcgagcttccagtcgtagcgatccggtgcaccgttgaacatgtcgaggttgtcggaagtacgcaggccatccgccgcggtacccgggccgtcataggacacttgtggcgcgcgacgcacgcggcgctgaccggcgttgtagacccacgctgagcgcggttccttcacttggtcgagagtctcgtgcaccagcagcacgccaccggccagacgtgccggcgcggtcactttctgcttgaagtagaacaggatgttgcccggattcgccggatcgtagtccttcatcttgtcgcggaacacgaactgatcctggaagtacaccaggctgtacgagccgttcggttgcggcgtggcctgagtcaccagacgggtcacgctgccgccgcgatagcgggtgatgtggttccagatgacttccacaccggttttcggaatcgggaacggcacggcggtatcgaagttttccagaccgttgccgccggacaccagattggtggtggtggcgtttttcttgatggcggcgaacacgtcatccggcacggtcgcaccgcgatgggacggatacaccggcatcttgaaggtgtccgggtaacgcttgaacatcgcgtactgccccggcgcgagtttgtccttgtacttgtcgacgtctttcgccgtgatggtgaacagcggttgctcactggcgtatggattggacaggaaacccttgctgtcgaccgagccggcattcttcggcagtggcttccaggcaggaatggaaccatcggcattaccagccatttcggcgcccatcggcgtcaggctcttgcccagtttgtcggcttcggcggcaggtaccgcggccatgacaccggtcgccagcagcgacagacccagaacaccggcgtggaacagactctttgttattttcatatgtgtgttcgtcctgaaatgcagtgcttagaagttcacgccgaagctgagcgcaacgaagtcgcgatcatccacggtggtgtacttgccatcgaagaagttggtgtaagccaggctcgcggtgtaggtgttctggtattccgcgtcgacaccgaggctgacagccttgcgaccttcctcgaagttgccgccagggccaggcgagtaaccgctgacgtcgtgggaccaggccacgttcggcttgaggttcacaccggcgaacacgtcgttgtattcccagatcgcacgaccgcgatagccccaggaaaccgatgtggtgaagccgtcattgtcgcaattgcggctgcggttgttttgcggcgacccaggccctgcaccgttgatggtgctggcgttgagaatgttggagcaggtattgataccgccagtggccggcaactcacccgggccatacacgggatcgcggccataacgcatgtcggaacggctttccagcccgccgacataggtcgcaccgacttcaccgaccagggtcagacggctggcgcccatgacctgatcgaagaagtgcgtgaaggtggtctggatctgggtgatttccttgcgttcgtaaccgtgcagatcctgacccggcacgccgttgagtagcgaagcgttggtcagtgcaccgcccagtggacgtacaccggcaaacaggatgtcggtggagttcagctgcaccggcgcattcggacggtagctgatctcaccgctccacgcagtgcccgtaggcagggtggtggagaagctcaggccgtagagacgaatgtcttcagggtattcaatgaagtattgcgagttgcccgcgaccaataggggtgcgagtgcggcaaaaggccccggcagcccgcgcgccgtgttgtagacagattgcggcgcaccggtggcactgaagatcggcgcacggctgtggtagttcatgaagtaggcaccgaactcggtgtccagcggttcgtacatgtacttgaaggatgcgccccactggccgctgtcacgggcatcgcggtcgccgccacggcgtaccagaacaccttcttcgttgacgttgacgccgttggcggccaacggccccaaggcgacggccggaatctgcgaacgtttgttcagcacgcgcagattgtcgttgcaaccgtcggcaacgatgtccggctgcgagaagaacgtgccgcagttgtcgacgacggtctggtcccattccagttgatagaacgcttcggccgagaggttctcggtgagactctgggacacatagaacatgttgaccgggatcaggccttccttgatctcggcgcccggacgacggaacgccgacacgtcgatcgggttgatcgagttgatgccgccgccgatgaaggtactctcaccccagctcacgacctgcttgcccagacgcaccgagcccggctgatcggcaaccgaatagttgtgatagacgaaggcgtcgaggatctgcccgccggacgacttggcgccttccttgcggttgctgtcactgatgtccttgaactgtcggctttcgtccttgagttcgaagtcgtaccagtatttgccacggacgaagacaccggtgtcgccgtatttcagttcaaggtcatggatgcccttgaagattttcgagaaggtctcgccgctcttgaagttggcgtggccgtcatcggaggtctgcgacaggccatggccgccgttgttgacgccgatgaggttcttgttcgggctctgagtagaccaactggcaccgatcgacagagaagagtcgaactggccttcgatttcaccgacgttgaaactgacgccgaatgcgggcccggcgagcgaagaggcaatgctgaccgccagaggcagttttgcccggcgccagaactggtttactgaggtcatcgacgctactccatgtgcattattgttatggcagtgagtacttttaaaaacgctgtggaagaccgggcgccagggctgcccgaaatcattccaaagttgctcgccccgttcagtgcgtgtgctccgttcttaaaaatccttgagcggactatagccagcaggtggtactgcttgatccctctaaagtgtgatttgcagctgccggccactctggaacagtcctttcgccagtccgacacgtgtcggcacggcaaggatggctgaatttttcgatttcacaaggcaagcgcttgcttggtgggcttggcgcgccgttttcggcgcgccggcagacacttaaagtgtcgagaggaaggtactgttgttagcctgccattcggtgatgtcgaggcggatgcgcttcttgtcgagcttgccgacactggtcttgggaatttcggtaacaagggcgatctgactcggaatcgcccacttgctcaggtgccccaattccacaaatggcttgaggtgttccttgagctcgcgcgccccgatcacgtgcccttcgcggatcaccagcagggcaaacggccgctcgccccactgcggatcggcaatgcccaccactgctacttcgcgtaccgcgacgtgtcggctgatcaggtcttcgaggtccagcgaggaaatccattctccgccggtcttgatcacgtccttgatccggtcgcggatgtcgatcacgcccatgctgtcgagcgtggcgacgtcgccggtgtgcagccagccgccggcccagagttcggcacccttctgcggttcgttgaaataaccttcggtcagccagggtgcgcgcagcaccagttcgccctgggtttccccatctgccgggagaaaattaccttcagtgtcgacgatcgccgcttccaccaacggcccaggcacaccggccttgatcctgtaggtggtgcgttcatcttctgtgccggccatcagttcgtcgtttaggtgagcacaggacaccagcgggccggtttccgacatgccgtaggcggcggtgagctgaatgccacgggccttggcggtttcatacaaggtgcggttgagtgcgctgccgccaatgacgattttccagccaccgaaatcggtgctctgcgcgcctttggcgttgagcagcatttgcaggatggtcggcacgcagtgagagaaggtgaccttttccttgcgccacaactccacgagaaactccggatcgtagcgccccggataaacctgtttgagcccgagcatggttgccacgtacggcagaccccaggcgtggacgtggaacatcggggtgatcggcatgtacacatcgttggtgccaagcaggcgtacgctgtcgatcgagcccatgatcgtcgacacgcccatggtgtgcagcaccagttgccgatgggtgaagtacacgcctttcgggttgccggtggtgccggtggtgtagaacgtggtggcgacggaattttcgtcgaagtcctggaaatcgtactgcgcactagcggcggccaacagttgctcgtactcgccgaccagattcggcaagtcggcagttttctccggcagatcggtcaacagcagggttttctcgaccgtggtcaggtgcggcgcgatcgcctgatacagaccgacgaactcgctgttgaccagcacaaagcggtcctcggcgtggttcatggtgtagaggatctgttccggcgacagacgcacgttgatcgtgtgaatcactgcgccaatcatcggaatcgcaaacatgcattccagataacggtggctgtcccaatccatcaccgccaccgtgtcaccggccttcacaccggccgccgtgagcacattggccaggcgtgccacccgttcgatcagcgtcgggtagctgtagcgcaactggtcacggtagatgatctcgcgggttttctcgtaacgggcgccggacatgagcagccgtttgatcagcaatggatactggtaggccccatcggccgggggaatgacgcgagtctgcaacataagaatcccttttctgactgcacggtgttggcgtagagattggtactctagaacccttatacgccagccaaatcagccaaaggaatgatttgcaaagccgtacaaatgctagctttgcgccagcatttgccggttttcatcatttgtcaggcggtttgtcctacagcctcttcagaaggcgtgcgtgggaaaaccaccgcagcgaggaaggtcaatgcgccgaagcccgcgagaatcaaatacaggcctacgaaaccttggcgcggttcgacataggaaatcagcggaatcgccgtggcgctggcgccgaacgataaacagtaacgcagggcaaagattcgcgattgccattgcggggcgacgaagttggcaaccatcgcatcgttcactgttacctgaccaaacaccacgaacatgaacgctgcacccagcgcgatcactgcccagccgtcggcgtatgccagtgcaaacaacagcggcgcctgacacagggtcagaacaatgaacggccatttcaggctgaggcggtgcagcactcggccgatgctcaactgcgcgaccgcaccaaaggcataggccaggctgaccaccacgccaagggtttgcggcgaagcgaacaattcatgcagacgttcctggaacaatttcggataggtcatggtggtggcgttgaacactacgccgccagtggccgtggccagcgccagcacgccgaacaccatgaccatcgaaatgcgctgaccggcggcgcctttgagcggcgtgtgcgggcgtttcgggatcggttcttctcgcacctgcaaggcgaaaccgacgcccaacacaatcgccaccgcgcccggtaacagaaatgccgaacgccagccgagctgcgccaccagcaagccggtgatcagcgccgaaaacgccacgcccagattgccccacatgccgttgatgccgatttcacggccacggttttgtgcataagcgaccaacatcgccgtgccgaccgggtgataaatcgccgcaaaaataccgatcagggtcaggccgatcaccagcatggtcgggctgttactcaggccagtgaaaatcgccgaggcgccgatgccgaagaaaaacatcagcatcatctgccgccggctccagtgatcgcccagccaaccggcgggtagcgagcaggccccgaaagcgatgaagccgcccagcgacaggcctatcagcgcggcatagtcgaggccaaaggcctgggtcatgccgagcacggcggcgggaaagatcagcatgaacatatgatcgatcacatgggcggcgttgatatagcgaatgacgtttctggattgattcatggcggcacgctttacgttgttgtgtgccgcttatgctaagttggcgaaaaagcgcattcctgccaaacaagtcatcgaatccgacatgttgatcagccacttcgaacacggcccggtgagcgcctatccccgggattatctggacggcgcgcaccagccgttgcacctgcatcgcgaggcgcaattgttgtatgccgtcagcgggatcatgcgcgtggtcacgcaatcgggtgcgtgggtgattccgcccagccgtgcagtgtggattccgcccgaggtggcgcacgagattttcatgagcggcgatgtgcagatgcgctcgctgttcatcgcgcctgcgctgtcgcccgccagcctgcaacaatgctgcgtactggccgtgacgccactgctgcgcgagctgatcctgcgtgccgtgcaagggccgccgcatgccgacaatcccttgatccagcaactgatgctcgaggagctcgccagtctggaaaacctgccgctgcacattccgatgccgaccgatcggcgcctgcagaacatttgtctggcgctgctgcacaccccggatcacccgaacacgctggaagactgggcacagcaggtcggcgccagttcacgcacgttggcgcggctgtttcagcaacaagtgcagatgagtttcaacgcctggcgccagcaattgcgcctgatggaagccttgccgcgcctgctcgccggggacagcgtgcagcgtgtggcgcgggatctgggttacggcagtgcgcgggcgttcagcgcgatgtttcgccgcttgctcggggagaatccccgcgaatacctgaataacctgagcaagctcagcgagcttgtgtaggagctgtcgagtgcaacgaggctgcgatcttttgactttgttttttaagatcaagatcaagatcaaaagatcgcagccttcggcagctcctacacagtaggatcaatgcatctcggtaaacgcgattttcacgccgagagcgatcagcaccgcgcccatggtgcggtcgaaccagtggcccatgcgggcgaaaccggcacgtacacgttgctggctgaacagcattgccaccagacagaaccaaaacgcagtcgcgaccgccagataaaccccgtaaccggcctgcaccgccagcggcgtatgcgggttgatcaccaccgtgaacagcgacaggaagaacagcgtggctttcggattcagaccgttggtcacaaagcccgaggtgaacgcgccgcgagcggtgcgcacaccggcctctttgtgcagatcatccgtcacggtttttgccggttgcgcgcgcagggccttgaagccgatgtacagcagataagccgcagcggcccacttcaaggcgttgaacagcacgatcgactgcgacacgatcaggccgataccgagcagcgaataaccgacgtgcaggaaaattgccgtgcccacgcccagtgcggtccaggtgccggcgcggcgaccgtgggtcacgctctcgcgcaccaccacggcaaagtccgggccggggctggccacggccagcagatggatcagtgcaacggtcaagaactcggtccagtacatgggggctcctttcggccaagcgtatcaatttgtttcatctggtaggctcggcagattacgccctacgctcaaagcctaaaaggtacagttgatgacgaacacgcgccgcgcggtattccttgatcacccttcgctggatctcggcgatctggacctcagtccgttgcgtgattgtttcagcgatctgcaattgttcgcccagaccttgcccgaacaagtcgccgagcgtttgcaaggcgccaccgtggcgatcagtaacaagatcctgatcgacgccgccgccatggccgccaaccctgatctgaaactgatcctgatcaccgccaccggtaccaacaacgtcgacctcgccgccgcccgcgcccacggcattaccgtgtgcaactgccagggttacggcacgccgtcggtggcgcaacacacgatcatgctgctgctcaacctcgccacacgcctggccgattatcaaaaagctgtgggtgaaggccgctggcagcaggccagacagttctgcctgctcgactatccgatcgttgagctggaaggcaaaactctcgggctgctcggtcatggcgaactcggcggtgccgtggcgcgactggccgaggcgttcggcatgcgcgtgttgctggggcagattccggggcgccctgctcgcccggatcgcttgccgctggaggagctgctgccgcaaatcgatgccctcaccctgcactgcccgctcaacgagcacacccgccacttcatcggcgcccgcgaactggcctcgatgaaacccggcgccttcgtggtcaacacggcacgcggcgggctgatcgatgagcaggcgctggccgatgcgttgcgcaacggccacctcggtggcgccgcgacagatgtgttgagcgtcgagccgccaaccaatggcaatccgctgctggccgcggacatcccgcgcctcattgtcacgccgcacaacgcctggggcagtcgcgaagcacgccagcgtatcgttggccaattgaccgaaaacgcccaggcatatttcagcggtaaggcgctgcgggtcgtcagttgataaactgcggcacttttttttgaggagcagttatggatccgcgcagtgaagtactgcttcgtcagcccgagttgttccagggttcgttgttgctggccggtttgcctgccgatgatttgctcggccgtctgcccgacgcgttcggctggtgctggcatgccggcgatcaagccgcgctggacgcccgtttcgaaggccgcagccatttcggcgtgaacgtgccggagcgtgagttcgacagcgccgtggtgttcctgcccaagtccaaggacctgaccgattacatcctcaacgcggtggcatcgcgtctggccggtcgcgaagtgtttctggtcggcgaaaaacgcagcggcatcgaaggcgcgtccaagcagctcaacccattcggcaagccgcgcaagctcgacagcgctcgtcattgccagctgtggcaagtgactgtggccaatgccccggaagcgaaatccctggaaagcctggcgcagacctatgaattgccactggctgaaggcccgttgaaagtcatcagcctgccgggcgtgttcagccacggtcgcctggatcgcggcagcgccctgttgctggagcatctggacaaattgccgagcggtcatctgctcgacttcggttgcggcgcaggtgtattgggcgctgcggtcaaacgtcgctacccgcacaatcaggtcacgttgctcgatgtggatgcgtttgccgctgccagcagccgtctgacgctggcggccaacggtctggaagctgaagtgctgacgggggatggtatcgatgctgcgccgatgggtttgaatgcgattctgagcaacccgccgttccatgtcggcgtacacaccgattatttcgccaccgagaacttgctgcgaaaagctgccaaacatctgaaaaacggcggcgaactgcgcttggtagcgaacagctttctcaagtatcaaccgctgatcgaggagcatcttggcgtgtgtgcgatcaaggctgaaggcaatggtttccgcatttaccgggccaagcgcggctgaaaatttgttcttgcccaaacggatttgcctaggcagaatccgctccgtcctaggggagtagtctcccacgagcgccaagctcgtccggcatacgtcaacatacttgatcctcagatcatggcgtatgcgacccaagcgtccgcagcagacggatcgcagggtttgacaagacctatgacacgcacaccttacccggggcgggaaggctgtacgtgtcatagccgtgtcgacccgccccttaggaaatcctgatgctggactcgttactcgttcccaccgcaatcgttgccttggccgaaatcggcgacaagacgcaactgctcgcgctgattctcgccgctcgcttccgcaaaccctggccgatcattgccggcattgtcgctgcgaccctggccaaccacgcagcagccggtgcggtaggcgcctggttcggcagtttcttttcgaatgcgacgctgcactggatcctcgccgcgagcttcacggcaacagcgctgtggacattggttccggacaaaatggacgacgatgaaaccagcaccgcgcgcaagttcgggccgttcctgaccacactgattgcgtttttcctggcggaaatgggtgacaagactcaggtcgccacggtgatgctcgccgcgcaatacccggatctttggctggtgattatcggtacgacagcgggcatgttgattgccaacgtgccggtggttctggcgggtaatttcgctgcggacaaattgccgctaacgctaatccgtcgcctcgcggcttcggcattcatgattctggcgatcgttgcggtgtacaaggcgatgcagagcagtggctgggtttaaccctgagagaaagatcgttcccacgctccgcgtgggaacgcagccggggaggttctgcgtccccgcctggaacgcggagcgtcccttgaggcattcccacgcagagcgtgagaacgatcaccgactcaggacttcggggcttgttcgtacagcggcataaccttcggaatcgctgcctgcaacgcagcagtgcgactatttgaagacgggtgagtactgaggaactccggcggagcaccttcgctggccttgctcattttctcccacagcgtaatggccgcattggggttgtaaccggcccgggcggcgagctccagaccgatcaggtcagcctcgttttcattggtgcggctgttaggcaacgtcatcaacagattcacaccattgtttcccacctccaccaaagcgggtggcgcacccgccgctatcgccatctgttgcgccatttgcacgccgtaagacttcgacaaggcctcgcgaccatgctcgcgcaaggcatgggcaatttcatggcccattaccgcagccgtctcatcgtcggtcagttgcagtttgtcgagcagaccggtgtaaacgatgatcttgccgccaggaccacagttggcattgagctcatcgctcttgatcagattgacttcccatttccattgcgcagaatccggcctgaacgtcggcgcctgggcaatcaatcgatcggcgatcgcctgaatgcgtttcgcatcagcgctggttttgtcgagcacattcttgctgctcgcatcacccagggtctgctggtagtcctgggcatacgcttgattgacctgctcgctcgacaccagactgaacatccgctgctgacgaaccacccccacctcaccggcactggtggtgttcaccgtctcacaaccgttgagcaacagcaccgagcccagtacacccgctatcagcgacttgttcatcccatcactcctgatatccgcactctgcgacaggcagactgtagtaggaaaaaattcatactgaactgactgccttgccggacaaaggttctgcacctgtctgaatgcgacacggacacatccaaaacggtcaattcagccccttttgctcatgtccattagctcccctgccgatacatcaccgcagacgtcctcttgcgtgcggagctcccatgaagttcaagtcgatccagttttccgtcgccgccctggccggcgccatcgtcctcagcgtggtcgccgcgctggtgctgtacgcgctgttttccggcgcgcgtacgcaagagatggtgcaacagcgcacccaggcgcagttcgagcaggtcatcgaacagcgcctgacctcgctggcacaaacccaggtcagccagatccagcgcgaactcgaagcgccgctgctgattgccggcgggctggtgcgggtcaatgccctgctcggcacgccgggcgccgacggccagccgcgcctgagcgtcagccgcgaacaactgatcagcctgatcaaagagaacgtcgaaaagaacccgaagattctcggcacctatatcggttgggaaaaaaacgcactggatcacaatgacgcagcctacgtcggcaccagcgtagtcggtatcgatgcggccaacgggcgcttcctgccgtggtggttccgcaatgatgatggcaccctcggtctggacaagctggtcgacgtcgacgatcagaaaaccctgtccaccggcgtgcgcgccagcgagtactacctgtgctcgaaggaaaccagaaaagcctgcgtgatcgatccggcgccttacaaagtcggcgacaagatcgtcatgctcgcctcgttcattgaaccgatcatgctcaacggcgcgttccagggcatcgtcggcgccgacctctcggtgaacttcattcaggaaatgctcctcgccgccaaccagaaactctatggcggcgccggacaaatggccctgatcggcggcaacagccgcatcgtggcctacacccaggacccgagcaaattcggcgagaaagtcagcgacatcctcgacgccgagcagattgccaatctggccaatctcaagcgcggcgaagtcacctactccgtcaacaaggacaagggccgcatcgaattgtacctgccgttcggcatcggccagaccgacgcgcgctggacattgatgctgcaattgcctttgaacgcggtaatggcggatctgcaaaagctgcagggcgatctggatacccagcgcaagtccgacacgttcggcatggccatggtcggtctgctcattgccggcctcggcttgctggtgatctggctggtcggccacggcatcgcccgtcctttgaagcagatggtcgccatgctcaatgacatcgctcagggcgaaggtgatctgacccgacgcctgagcagcgatcgcagtgatgaactgggctcgatcgccaaaggtttcaacacgttcctagccaagttgcaggcgatgatcacccaagtggttacgtcggtgcagagtgtcagcgattcctcggaacacactgccgacatcgccattcgcaccaacatcggcatccagaaacaaatggccgaaatcgatcaagtagccacggcggtgcaggaaatgaccgccactgcacaagacgtggcgcgcaacgcgacccaggctgcgcaagcggcgagccacgccgatcaggcggcgagtcagggcatgcagatcgtccgcgacacgtcgaattcgatcggcgtactcgcgctggaaatcggcaaggctgtgggtgtggtgcagacgctggccaaggacagcgaaaacattaacgccattctcacggcgattcgcgggattgccgagcagaccaacctgctggcgctgaacgcagcgatcgaagcggcgcgtgccggcgagcaaggtcgcggttttgccgtggtggccgacgaggtgcgtaatctggcgcagaaaacccagaaagccaccgaagaaatccagagcatgatccagcaattgcaacagggcacccgcgatgtcgtgcgggtcatggaagacagccagaaccgcactgatgaaagcgtgcaacacgcggcgaaagcggcggaggcgctggagacgatcacgcaggcggtgtcggtgatcaacgacatgaacacgcagattgccagtgcggcggaagagcagagcgcggtggccgatgacatcaatcgcaatgtgatcaacatcggccaagtggccaatgaagtcgcgggcggtgcggatgagtcgagttcggcgagtgctgatttaaccaagctggcagagcagcagcggcggttgatcaatcagttcaaggtctgaggtgaagacaccctcaccccagccctctcccggagggagagggggccgaccgagttgtctcccgtcatacatcgacctgaaataaccagtcgattatggattcaaagcagagcgttcaagtcggtgtattgcgtcaatatcccccaatcagtcccctctccctccgggcggtccgacgtttcgggagggctagggtgaggggcttttgaccttcaggctttaacccggagtcaaacactccggcccgttgagcttcggatcattgatcagattcgccagcactcgctcgcgcaacgccgccggttcactcgccagcaagccctgcaacacatgcagcggcgtctcgggatcgagccacgccgcctgccccgcctcatcgagaatcaacggccgccgctgactcgacgccggctgagtaatcaccgccgtactcaaccacacctgttcctgcaccggatacgcctcccagatcgccgcaaaaaacagcgaagcgccctcccccggcgtcagccagtacggccgcttgcgctgcgttccgcgccattcgtagaaaccattcgccggtagcaggcagcgacgctggcgcagcgcctcacgaaacatcggctgctcggccacggtttccgcacgggcatgcgccggggtcttcgacagatcggtcagccacggcggcgtcagcccccagcgggcgcgggccaacgtgcgctcaccggcttcaccggcacgcagcatcaacaccgaatcattgggggaaatgttccactgcgcctgctgatcggcgggaaaacctggcagggccgcaaaatcgcggttccagcgaaacagggcataacgtccacacatggggcaacacgactctgaagtaaaacgaagctcagcctaacagaccagcgtcccggggaagctctccggttcatcgccgggcagcggcagcgcggcattgtacgcggtgatcagctcgcgggcgtattcggcctggtcgttatcgacggacagtcccagcagaccgaaaatcggtaactcgcccgtgccaccgagcaaatcgcggccgatcaagtgcgcctctatcccttcgctggcgagcatgcccttgagcatttcaccttccatcaggttttccggctcgtagattcgctgcatgggcgcgcctcactcgttttcgctgaagacttccagaaaccagtcctctccgtggacctgcaagacaaacgtgattggccggcaacacacctgacagtcttcgatataggtctgatccccgccggacaagtccaccgtcgtctcaacaacctccccacaataaggacaatcatactgagcagtttccagcatcgcggtctcccaagtgacttgtgcgtataatcgccggtctatttgcagggctatttttgtctggctaccttttcagaccgtgccccgttggttttcgatcaaaacctttacttaccctagccgtttccaacaagagagcatgatgggcgaattcgatgccatccgaccttacgacgacagtgaagtacctgtggtactggcacgactgctcggcgacaaggcgtttctagatatcctcacccacttccgcttcccgcgttttgccggtgctttcggctggatgctcaaaccacttatagcccatcggctgcgtcgtgagttcgccgacgtgacctcggtggcgacgttgcaggacaaggtcgagtcctacgtcgaccacaccattgagcgcgccaccgacggcgtgacctacaccggtgtcgagcaattcaagtccggcagcgcctatctgttcatcgccaaccaccgcgacatcgtgatggacccggccttcgtcaactacgccgtgtaccacgccggcctgccgacgccgcgcatcgcgattggcgacaacctgctgcagaagccgtttgtcagcgacctgatgcgcctgaacaagagcttcatcgttcatcgctcgatcaccggtcgtcgcgagaaaatggctgcgtatcaattgttgtcggcgtacatcaaccattcgatccgcaacgattgcgcgtcgatctggatcgctcaggctgagggacgggcgaaggatggcgacgaccgcaccgagtcggcgatcctcaagatgttccacatgagccgcaaggacgagccgttcggcgaagtcattcgctcgctgaacgtcaccccggtgtcgatcagctacgaatacgacccgtgcgaccaggccaaggctcgcgagttgtacatccgcgccaccaccggcacctacgcgaaagcgccgggcgaggatgacgtgagcattgccaagggcatcaccggctacaagggccgggtgcacgtgaatttcgctgcgccgatcaccgagctgttcgaagacaccaagcaattggcggtcgaaatggacaagcagattctcggcggttaccggttgttcccggtgcattacctggcgtatgcgcagtgggccgatgccgatccgcagttgaatgtgccgaaagctgccgaggtgttcccggcggatgagttggccaaggcgcaggaagaatggcaagaacggctgggcgcttgccctgaagagcatcgtccgtatctagtgctgcaatatgcgacgccggtgcgtaatcaataccgcgttaaggccgggttgccgctttaaattttcagagcaagagcaaaagatcgcagccttcggcagctcctacagtggattcatgcaggagctgccgaaggctgcgatcttttgcttttagtaacgcgtgctgatccacgagacgatcagagccagccccaggcaagcaaaaccaaatcgatagaaaaaccggttcatgcgcaaggtcgcccaatccagcaacggctcggcatttggctgtgcctggcgctgggcggcaatactggccatcgcgcgctgctcacgacggcgggtcgcgtgcagcagccaactgccgggaaacgccaggagcagcgccagcaggttgatcaatttggcgggatgggcggtaaacagcgtcatcaagtgcagcgacatcacagacctctatctaaaccggtatggcagacgccagatcgacgaccgcggcgcggattctaccgaaacccgagtgccctgccccagcctttgcgacaaattacatgacaatcgaccgatggctgtcccatgtcacggcatcgtcatgtggatacaccaagatgcgcgcctcgaaacgcacatggaacgcgacatgcttcacgctgaaaaccaggatcgcctttatctcattaccccttacgacgaacagcaaagcctcgtcggcagcctcgccttcaatgttcaggatcgccattggctggtgtattgcgcgctgggcgggcatcaacatgcggatttgccggagactgatttactgacgggtgtcagcgttctcgacttttactcccaagctgcttgaaaaagcaaaagcaccctcaccctagccctctcccggagggagagggaaccgaccgagttgcttggtcgaggtacatcgacctgaaacatccagccgaactccggttctgaaaagcccccgatcggctcccttccccctcgcccccttggggagagggctggggtgagggggatcgatttcccatacgccacaagtcccgaacctgacacccacaaaaaagcccgaaaccatcactggccccgggctttttcacatccgccgaaaacttactcagccaaaacctgacccacagtcggatccttgaacagacgcgtcagcgcatcactcaacacatcgctgaccagtttggtgttggtttcctggttcggcgccatgccgaaacgctggtccaacgacgcgccgtaacggccgctgtaacggcggttggcgttctgcacgtcggagcggaaagtcgcgccgatggtcgcctcggttacgtacatgccttctttcggcgactgatacttcagctcggccagggtcacggtcagctgtggcgcgttcggcgcgttgttggtcggggtgaaaccgagcagacgtacggcggcttcagcctgagcctgcagcttgggcaggatctgctcgcgctgcacggtgatggcgctggtttccgggtacagaccgccacgggtaccgagggttggcgacgggcgaccgtcaaccacacgcaccacgactggctggccacggccgaccgctggcagctgggtggtcagcttcggctccgggctcagttgttgcgggctgtgggcgcagccggccagggtcaaaccggccacagtgatcaaaccgaacaacaggcgttgcaacatgctcttctctccagaatcaggcacaaacaggccggcagtatagcggtgggccactgcgggtaaccagcgcccggcagcgaatactgaaatgtctgacaaaccccgttgaaggcggttcctgtcacagattgttcaccggccatacacgttcgcgtcacggcgtgttgccaaccttcacacaagtcctccagcaaggtactcagccatgcgttatctgatctcgttgttcgctccacgcccgctgcatcgcagctttgccctgctcgaccgcaacggccattgccaggcattcaagcagtgcagcctgcagcccatgggcgacggttgggtggaaatcgaagaaatccgcctcaactggttacaccagccattgcccgccagcgcccgcgtcatagcgtcgcagcctcgcgcacgggtgcaagcgatgttgagcatctgaccggatgcctaataaaagtcattaaacacgagcaacaccgcgcatttcttcgatacaatctccccccgattataaggacgtctcctgatcgggccccgcaacagcgtcaatgcgcatgcatcgacacccaaaatcgcccacagagagccgcccacacagatcgagtgaagttggcgcgcttgcctgttcttccggcaaaaacccgcttttcgcgaatctgcagagctgtcatgacgctcggccaccgcgttgttttgcctttgcgggcaaggtgccaggcctggacagcccttttttgaggttcacgtcttcaaaagagcgtgaaaaaaacgggttttcacaacttcacaagagtgtggcgagcaaatgaaaagttttgcgtctgaacatgcaccattagcgtctgaaacagcccaacgacacaggaccgggtatacctcgaatatcggagcctgaagcctgtccgctacggatttggttgcacaaaaacggatgtctcgaccataagtcgaattgccagctgcgtgctgaaatgagttcatggagctcttgaaagccaagccgcatacatccgtcgaagttgcgaaaaattgcgaagattcggacatggcgaacctgaccacggatagcccggacactactgacctgtcccggaacgcctggcagccatgccgacaatttggtgctgcagattttggagacgcgttaaatggcgcataacgaagcagtcgacgtagttctggttggggccggcatcatgagtgccacccttgccgtgctgctcaaagagctcgaccccgcgatcaagctggaagtcgtcgagctgatggattccggtgccgccgagagttccaatccctggaacaacgccggtaccggccacgccggcctgtgcgagctgaactacacgccgcaagccgccgatggcaccgtcgacatcaagaaagccgtgcacatcaacacccagttcgaggtgtcgaagcagttctggtcgtacctgaccaagcaaggcacgttcggctcgtgcaaatccttcatcagcccggtgccgcacctgagtttcgtccagggtgacagcggcgtgtctttcctcaaatcgcgcttcgacgtgttgagcaagcaccacgccttcgctgacatggagtacaccgaagacaaggccaagatggccgagtggatgccgttgatgatgccgggccgctcgccggacgaagtcctcgccgcgacccgcgtgatgaacggtaccgacgtcaacttcggcgccctgaccaatcagttgctcaagcatctgaccagcgctccggacactcaagtcaaatactgcaagcgcgtgaccggcctcaagcgtaacggcagcggctggaccgtcagcatcaaggacgtcaacaacggcaacacccgtgaagtcgacgcgaagttcgtcttcctcggcgccggtggcgcggccctgccgttgctgcaggcctcgggtatcgaagaaagcaaaggtttcggcggcttcccgatcagcggccagtggctgcgttgcgataatccggaagtggtcaagcagcaccaggccaaggtttacagccaggccgctgtaggttcgccaccgatgtcggtgccgcacctcgacacccgcgtggtcgatggcaagaagtccctgctgttcggaccatacgccggtttcaccaccaagttcctcaagcacggctccttcatggacctgccgctgtcggttcgcgccggcaacatcgggccgatgctggcggtagcgaaaaacaacatggacctgaccaagtacctggtcagcgaagtgatgcagtcgatggaacagcgtctggattccctgcgccgtttctacccggaagcgaaagccgaagactggcgcctggaagtggccggccaacgggtacagatcatcaagaaagacccgaaaaagggcggcatcctgcagttcggtacggaactggtgtcggccaaggacggttcccttgccgcactgcttggcgcttcgccgggtgcgtcggtgaccgtttcgatcatgctggaactgatcgagaagtgctttccggccaaggccaagggtgagtgggctggcaaactggcggaaatcttcccggcccgtgaaaaagtgctggaaaccgatgctgcgttgtatcgcaagatcaacacgcagaacaacatcgcgctggagctggttgaagaaagcagcgagaccccaagctacgcttgatcttgccgcataaaaaacgccccgatcggggcgtttttttatgcctgtcaaaagtaaaagatcgcagccttcggcagctcctacatgaccgtgtaggagctgccgaaggctgcgatcttttgatcttaagcgcgggacttttcgatcagctcgatgtattccggggcgttgcgctgatcggcgatcagctcaacgaaggtcttgccctgctcgtccttgccatcgacgtcgtagccagctgcaacgaagaaacccagaaagcgctcgaagtcatcgatgcgcaaaccacggtaagccttgatcagtttgtgcagcgacggcgaagtggcgtcgaccggttcaaaatcgaggaacagcttgatctgctcatcgccgatctcgtcaccaatcacttgtttcttatctttacgcattgccgactccagctcgcagacattacacggggcgggcagtttacccctgcccgaccgccaggctcaacgcgaacgcaccgccccggtgtgcaaatcggcccagatgtggccgttggcgtaactgaggaactgcacatacacagtgtcattgcgcagcagatcgatgatcacgcggtattgggcctgtggataaaacaatgtcagggttttgctcttgtcgtcgtagatcggctttttcaggcttttgctctcgccgtcgaaattgaccagcacctgagtaatgctcgcgcctttgttcagggacttgcccttgaggcgaatcatcaatggcgaggtgaccggaatcggctgctgattggactggcgttgcgcgcccaccactacggaatagtcggtgacctgcatgagttgctgctgctcaggctcggcatcgcgcagggtcagatcgtccggcggcaggaactggctgtgcatcggcgcggcggacagcggcaggctgacggccagcaacagggcggcaaagctgcggatcaagaggcgcatgacaggctccggagggcggggccgagcactctagcatgggtatcatgcaaacaaatgtaggagtgagcctgctcgcgatagcggtctgtcagcaacgtagatgttgactgatacgacgctatcgcgagcaggctcactcctacgggcatggtgcagggttcttacatgcctttaacggcaaagatcccgttggcgttacgccagtagcctttgtagtccatgccgtaaccgaagatgtagcggtcgatgcacggcaggccgacgaaatcggctttcaggtcaggacgtgctttgcggtcgtgatccttgtcgatcagcacggcggtgtgcactttgcgcgcgccggcgtgtttgcagaagtcgatgatcgcgccgagggtgtgaccttcgtcgaggatgtcgtcgatgatcagcacgtcgcggtcgatgaacgaaacttccggcttggctttccagaacaggtcgccgccgctggtttcgttgcgataacgggtcgcgtgcaggtaggacgcttccagcgggaagtgcagatgggtcagcagcttgccggagaagatcaggccgccgttcatcacgcagaacaccaccgggttgctgtcagccagttgttcgttgatttgtgcaccgacacgggcgatggccgcctcgacttcagcttcggtgtacaggcagtcagcctctcgcatgatttgacggatatgctcgagatcagcggacatggcgctctccagggggggatgttttcggaaaagcgggcaaaggtacgcatccattgaggccgaatcaagcctttatggactaacgtacagaatgtcctataggacatcaccctcggatagattaatctaggccggtttttttgcccgccgccggagtttttccatgcccatcctcgagatccgccatccgctgatccgtcataaactcggcctgatgcgccgcgccgatatcagcaccaagaacttccgtgagctcgctcaggaagtcggcgccctgttgacctatgaagctacaaaagatttgccgttggagtcctacgatattgcaggctggtgcggcaccgtgtcggtcgagaagatcgccggcaagaagatcaccgtcgtgccgatcctgcgcgccggcatcggcatgcttgaaggcgtgttgagcctgatcccgggtgcaaaagtctccgctgtgggcgtcgcccgcaacgaagaaaccctgcaagcgcacacttatctggaaaagctggttccggaaatcgacgaacggttggcgatgatcatcgatccgatgctcgccaccggcagctcgatggttgcgaccattgatctgttgaagaaagccggctgcaaagacatccgcgccatggtgctggtggccgcgccggaaggtattgcagcagtcgaaaaagctcacccggatgtgaccatctacaccgcgtccatcgatgagcgcttgaacgagcacggttacatcatccctggacttggcgacgccggtgacaagatcttcggcaccaagcagaaggacgcgtaaccatgcagcaagagttcaacgatccgctctggcgcacggtgctgtccggcgcccagatgctgttcgtggctttcggcgccttggtgctgatgccgctgatcacgggcctggacccgaacgtggcactgtttaccgcaggtctgggaacgatcctgttccagatcgtcaccgggcgtcaggtgccggtgtttctggcgtcgagcttcgctttcatcaccccgatcattctcgccaagggccagttcggcctcgccgcgaccatgggcggcgtgatggcggccggtttcgtctacaccttcctcggcctggccgtgaagatcaaaggcaccggtttcattgaccgtttgctgccgccggtggtgattggtccggtgatcatttccatcggtctggccatggcgccgattgccgcgaacatggcgatgggcaaggctggcgacggttcggaactgatccactaccagaccgcaatgatgatctcgatgccggcactgctgaccacgttgatcgtggcggtgttcggcaaaggcatcttccgtctggtgccgatcatttccggtgtgctggtcggttttgccatggcgttctatttcggcgtggtcgacacagcgaagattgccgcagcaccatggtttgcgatcccccatttcaccgcgccggagttcaactggcaggcgattctgttcattgttccggtggcattggccccggccattgagcacatcggtggcgtgattgccgtcggtagcgtgaccggtcgcgattacctgaagaagccgggcctgcatcgcaccctgctcggtgacggcattgccaccaccgcagccggtctgttcggtggcccgccgaacaccacctacgccgaagtgactggcgccgtgatgctgaccaagaactacaacccgaaaatcatgacgtgggcggcgattttcgccatcagcctggcgttcatcggcaaattcggcgcgctgctgcagagcattccggtaccggtgatgggcgggattctgtgtctgttgttcggttcgatcgcggcggtgggcatgaacaccctgatccgtcacaagatcgatctgggcgaagcgcgcaatctggtgattgtttcggtgacgttggtattcgggattggcggtgtgctggtcggcactggcaccggtccggacgacttcggcctcaaaggcatcgcgctgtgcgcggtggtggcgattgcgctgaacctgattctgccaggcaatgacggctggaaaaacaagaaggcggatgagccactgatctgaacctttagatcttcatcgcctgacagatagctatcgcgagcaggctcactcctacaaggtcaacgcaatacctgtaggagtgagcctgctcgcgattcgctttcagagcgccagcggtgctctttcgcagagggtcgccaacgccttcgcccaatgcgtgtcgtcgttcagacaaggcaccagcaccaactcctcgccccccgcttcgcggaactgttccttgccgcgatcaccaatctcttccagcgtctcgatgcaatcggcgacaaacgccgggcacatcaccagaattttcttcacgccgcttttcgccagttcatccaggcgcgcttcggtgtacggctcgatccacttcgcccgccccagacgcgactgaaacgacaccgaccatttgccatcaggcaggcccatgcgctgagcaaacaacgccgctgtacgcaggcattgcgcgcgataacaggtcgccatgaccgcaggagaggcgttcttgcagcagtcgtcattcttgaagcaatgattgccggtcggatcaagtttggtcagatgccgttccggcaatccatggaagctcagcagcaagtgatcgtaatcctgctgcaaatgcggcctggcgctttcgaccagcgcatccagatattccggctgatcgtagaacggttgcagcactgacaatttcacatcgagctttttctcgcggatcacccgcttggcttcctcgatcactgtggtcgtggtgctgtcggcgaactgtggatacagcggcgccagcgtgatgcgcttgtgccccgccgcgaccagtttcagcaggccggtttcaatcgacggctcaccgtatcgcatcgccagctctaccggcccctgcttccattgcgccttcatctgctgttgcaggcgacggctgagcaccaccagcggcgaaccctcctcccaccaaatcgaggcgtaggcatgggccgattgttccggacgcttgatcaggatcagcgacaccagcagacgccgcaccggccatggcaggtcgatcacgtacgggtccatcaggaattgattgaggtagctgcgtacatcggccaccgaagtggaggccggggaacccaggttgaccagaagcaaggcgtgatcggtcatgcaacgtcctatttcagaggcggctggaaagatcgtccagagccgcgcgtaaatccgtgaactggaaagtgaaacccgcttccagcaagcgtgctggcaaggccttctggccaccgagcaacaacaaagacatctcgccgaggccgaccttcagcgccagggtcggcatcggcatgaacgccgggcggtgcagaacgctgcccagcgtcttggcaaattcgcgattgcgcacaggttgcggcgcgcaggcattataaggaccactggcctgatcgcggtgcagaagaaaatcaatcagggcgatttgatcgtcgatatgaatccacggcatccactgccgcccattgcccaaaggcccgccgagcccgagtttgaacggcagcaacagccgcgacaaaaagccgccctcggccgacagcaccagaccggttcgcaccagcaccacacgaatgccttgggcctcggcacgctgtgcggtttcctcccaggcaatgcacaactggctggcgaaatcgtcgatcaccggcggtgaatcttccgtcaactcgcgctcaccaccgtcgccataccagccgatcgccgaaccggaaatcagcaatgccggtttctgcgcgcgggtttcgagccacgccaacaatgtttccgtcagcttgatgcggctgctccacaacaacgccttgcggcgatgggtccacggccgatcggcaatcggcgcaccggccagattgatgatcgcgtccacaggctcctcgccgagatcttccagacgcgcgatgccacgcacctgcgcgccgcagatcttcgcgaccttctccggtttacggctccacaccgtcaggcgatggccctgctgcgaccagtgtcggcagagctgacgtccgatcaaaccagtaccgccggtcagcaatatgtgcatgacatcttcctcgcgtggcgttttaccctgatcactagtctatttttataaacagggatcttttctatcgggcaggctctattgtttaaccataggccaagctgtcagaacgagaacgctagaagttataccaaaaaacaaaattgtacaggtttcatccacggcgtagtctgtacagaaaggtaaacgaggcccctatgactgtacctatcgcaatcatcggcaccggcatcgccggactctccgccgcccaggctctgacagagaccgggcataccgttcaattattcgacaaaagtcgcggcagcggcgggcgcatgtcgagcaagcgcagcgacgctggctcactggacatgggtgcgcaatatttcaccgcacgtgaccgccgcttcgtcaccgaagtgcagcgctggcaaagccagggctgggtcgccgagtggacgccgcagctctacacctgccagggtggccaactgaacctgtcgccggacgaacagacccgctgggttggtgcgccgcgcatgagcgccatcacccgtggtttgctcgacggtctggaagtgcatttcgcctgccggattaccgaggtttttcgcggtgaagaacactggcatttgcaagacgccgaaggcttcacccacggcccgttcagccacgtggtgattgccacgccggcaccgcaagcgaccgcgctattggccgctgcaccgaaactcgccggcgccgctgcgggggtgaagatggatccgacctgggccgtcgccctcgccttcgacacgccactggatacgccaattgaaggctgctttgtgcaggacagtccgctcgactggctggcgcgcaaccgcagcaaaccggggcgcgacaacaccctcgacacctgggtactgcatgccaccagtgcatggagtcggcaacacatcgatttgtccaaggaagcagtgatcgagcaactgcacggcgcctttgccgagttgctgcacagcgccatgcccgcgccgaccttcagcctcgcccaccgctggctctatgctcgccctgcgacaggtcacgaatggggcaccttggccgatgccgatctgggcctgtatgcctgcggcgactggtgcctttctggccgcgtcgaaggggcctggctgagcggtcaggaggctgcacgtcgcttgcatgagcacctgcagtgaagcgcatcaatccgcaaaaattgctgctgtcgaaatggacagcagcccatccgcagaaccgtgaaaaacactttctggtgaccgagttgttccgtgatgaggaaggcaaagtgctggaagtcgagttgcaggcggtgttgaccaaacgcgttgaacgcttcgattggcaagtcctcaagaacaacgatcactggctattgggctggcaataaagccccctgtaggagtgagcctgctcgcgatagcgggggaccattcaacatttttattgaatgacataccgctatcgcgagcaggctcactcctacaggaatcgcatcaaccggaaaaagttatacaaataatttgacttgtacacccatgaatctatgctgagcaaagttgtacagagatttacctctgtacaggtatggattcgaggtgttcatgtctgatccttgcgtagccaaacctaaaatcgccatcagcgcctgcttgctgggcgcggaggtgcgctacaacggtggacacaaggaatcacgcctgtgcagccgcaccctcaccgagcatttcgattttgtcccggtgtgtccggaggtcgcaatcggcttgggcattcctcgcgaaccgatccgcctcgtcggcgaggtcgaacatccacaagcggtcggcacggtgaaccgggcgatcaacgtcacccagccactggccgaatacggcgagaaaatggccgctgaactcgatgacatctgcggctacatcttcatgcagcaatcgccgtcctgcggcctggaacgggtcaaggtctaccacgccaacggcgccccggtgaacggcggcgggcgcgggatctacgcccaggcgttttgcgcccgacacccggatctgcccgtggaagaagccgggcgcctcaacgatccagtgctgcgcgagaacttcatcacccgcgtgttcgcctacagcgaatggcaacaagtcatcgctcgaggcttgagccgccgcacgctcaccgaattccattcgcgctacaaatacttgctgatggcgcacaacccgctgcaatacaaggcgctgggcaaactgctcggcaacatggccgacaccgatcccgtcgaactgggcccgcgctatttcagcgaactgatggcggcgctgaaaaaatgcgccacccgtggcacgcactgcaacgtgctgctgcacatcagcggttatctgaaacaagtgatcagcgccgaagacaaacaggaaatggttcacgtcatcagccaataccgcctcggcatcgtgcccttggtggtgccgttgacgctgctcaagcatcactttcgcctccatccggacccgtacatcgcgcaacaggtttacctgcaaccgcacccggaaaacctcagtctgcgaaacgccatctaatgaacgacaaactcgataccagcgctcaggaagaccttggcgctgattttaaaaaagccctcgacgagggctggctgccgattcgcgaagtcgcccggcaaaccggcgtcaatgcgatcaccctgcgtgcgtgggaacgccgctatgggctggtcgtgccacaacgcacccccaaaggtcaccggctgtattcggccgaacatgtgcagcgaattctgacgatccttacctggctcaaccgtggcgtggcagtcagccaggtcaaaccactgctcgacacgccacaggcgttcagcgaatcagtggaaaacgactggcagcgcttgcgccagacactgctggcggccgttacgcaactcagtgaacgcagcctcgacgacagcgtcaatcaagccatggcgctctacccgccacgcacgctgtgcgagcaattgctcatgccgttgctgacggaactggagcagcgctggcagggccaattcggtgcacagatggaacgcgtgtttttttattcgtggctgcgcagcaaatttggcgcacgcatctaccataacaaccgtcagttgcatgctgcgcccttgctgttgatcaatcattccgacctgccactggaacctcatctgtggctatgcgcgtggctgatcagcagctccgattgcccggtgcaggtgtttgactggccgctaccggtgggagaactggcgctgacagcagaacacctgcaagcgcgtggcgtactgctgtattccagcaaagccatgaaccttgcgcagttgccgaaactattgaacggagtgagttgcccgaaattactggtcggaccaacggtatgcatccaccacgccgagttgtccgtaaaaacttccgagatcgctgatttgtacctggctgaagacccgctttcagcgcaccaggcactcgttcagcgtgggctgatttaatggacgcagtgagttccgacatgcaattgatctggctgcgcagcgacttgcgccaacatgacaacaccgccctcgcggccgccgcagcgcgcggtccgacggtcgccgtgtacctgttgagcccgcagcaatggctggaacatgacgatgctccgtgcaaggtcgacttctggttgcgcaatctcaatgagctgagcaaaagcctcgacgagctgaacatccccttgttgattcgcaccgcagcgcattgggatcaggctccggccgaactgctcaagctgtgccagcaactgaagattgaagcgctgcacgtcaacgaagaatacggcgtccatgaaagccgtcgcgatgccgcagtggctgaaacgttgacagccaagggcatcgagtttcacagctatctcgaccagttgctgttcaaacccggcaccgtgctgaccaagaccgaaacctacttcaaggttttcagccagttcagaaaagtctgttatgagcgcctgcatcgctcgatgccggcattagtcaaggcacccggcaagcaggcaaaactcaaagtcgacagcgacccggttcctgacgcggtcaaaggcttcgccaccccgagtccatccctccaggctctttggccggccggagaaaaagaagcgcagcgtcgcctcgataccttcgccgacgcacaaatcgactactaccaaagcgaacgcgacttcccggccaagcccggcaccagtcaactctcggcctatctcgccgctggtgtgatttcgccgcgccaatgcctgcacgccgccctgcaaagcaatcagggcgagttcgagagcggcaaagtcggcgcagtcacctggatcaacgaattgctttggcgcgagttctacaaacacatcctggtcggttatccgcgagtctcgcggcaccgcgcctttcgcccggaaaccgaagccctcgcctggcgtgatgcaccggacgatctcgccgcctggcaagaagcgcgcactggcctgccgatcatcgatgcggccatgcgccaattgctggaaaccggctggatgcacaatcgcctgcgcatggtcgtggcgatgttcctgaccaaaaacctgttgatcgactggcgcgaaggcgagcgctttttcatgcgccacttgatcgatggcgacctcgcggcgaacaacggcggctggcaatggagttcgtcgaccggcaccgattcagcgccgtacttccgcatcttcaatccgttgagccagtcggaaaaattcgacagcgaaggcctgttcatcaagcactggctgccgcaactcgccggtctcaacaaaaaagaagtgcataacccggccagcgccggtctgttcggtgccgccgactacccgccgccgatcgtcaacctgagcgcttcacgggaacgggcgctgaccgcgttcaagaacctgccctcgcgtgaggccggagacgatcatgagtgaattcctgcagcgcttcgcccggcaattttcagcgttgaacaaagacaacctgcaacgcctgggcgagctctacagcgatgacattcatttcaccgacccgctgcacgaagttcagggcctggcgcaattgcgcgattacttcagcgagctttacgccaacgtcagcgaattgcatttcgactttcacggtttcgaccagatcagcgagggcgaaggctacttgcgctgggtcatgcgttatcgccacccgcgcctggcgggtggtcaggtgattcgcgtcagcggctgctcgcacctgctgtggcacgacaaggtttatcgccatcgggattatttcgatgccggggcactgctttatgaacatttacccgtattgggccgggtgatcgcctggctgaaaaggagaatgggatgagtcgtacaactccacggcgttattggttgaccggggccagcagtggcatcggcgcggcgctggctgaagagatactgaaaaccggtgcgcacctggcagtcagttcacgccagctcgcaccgctcaaagtgttatcgcaacgctatccgggacaggtattggtagtcccgggggatttgaccaacagccagaccgtgcgcgaaatcggccagcagattgctgaggactggggttcgctggacagcgtcatcctcaacgccgggacctgtgaatacgtcgatgccaagcagttcgatgcctcgatcatcgaacacgtggtacgcaccaatctgctcgccagcagttactgcatcgaggcagccctgccgctgctgcgcaaaggcaacgcaccgcatctggtcggcgtggcgagttcggtgacctatttgccgttgcctcgggctgaagcctacggtgcatcgaaggccgggctgcgttacttgttcgaatcgctgcgcattgatcttgcggacgagggcattgaagtcactgtggtcagcccggggtttgtcgagacgccgctgaccgccaaaaacgatttcccgatgccgctcagctggcctgtggataaagccgcgcggcacatctttgccaagctcaaggatcgacctctggagatcgcttttccggcactgttcatggcggcgctatggcccttgtcgaaactgcccgcgcgcgcgcaactggccatcggcaagcgcatggtgcgcaagccaccaccacagacggatccggcatgaagatcgccatcgtcgggagcggcatcgccgggctgacctgcgcctacctgctcaatcgccgacacgacgtcacggtgttcgaagccagcgactgggtcggtggtcacacgcataccgtggaggtcacggtcgaaggtcgcaagtacgccgtggacaccggtttcatcgtgttcaacgactggacctatccgaacttcattcgcctgctgggccaactgggcgtgccgttcaaaccgaccgaaatgagtttttcggtgaccgatccggacactggcctggaatacaacggcaacaacctcaacagcctctttgcccagcgcagcaatctgctgtcgccggggttctggggcatgctgcgtgacattctgcgcttcaataaagaagcgcaacgcgacctcctggagctgcgcatcgcggccgacaccaccctcgacgaatacctcaaggctggcggttacggcgaacgtttcatcctgcattacatcgtgccgatgggcgcggcgatctggtcgatgccgatggccgaaatgctcaattttccgctgcagttttttgtccggtttttcaagaaccacggtttgttgtctgtcagtgaccgtccgcaatggcaagtcatcgaaggcggttcaagcgcttatatcgcaccgctgacggccgcgttcaaggacagaatccgactcgcttgcccggtaacccgggttgaccgcgatgtgcacggtgtgatgatccacagcccggtgggcattgagcatttcgaccaggtggtgttcgcctgccacagcgatcaagcgttgaaactgctagcggttccgagcgatgccgaacgcgcgatcctcggcgccctgccctacgccgacaatgaggtggtgctgcacaccgacacgcgcttgctgccgacacgcaaactggcgtgggcgagctggaattatcgcctcggcggatccggccatacccaggctgcggtcacttacgacatgaacattctgcaaggtatccagagcgacacgacattttgcgtcagcctcaaccagagtgccggcatcagcccgttcaaagtgctcgccaaatacacctacgcgcacccgcaatacagcctcgcggcggtcgcggcgcaaaatcgctgggccgaactcgatggcgcgcaacacagccattattgcggcgcctattgggccaacggttttcatgaagacggcgtggtcagcgctttacgtgtggctgccgcgttcggggaaaccttatgaacagtgccctgtacagcggctggatcggccatcggcgcttctcgccgcgccagcatcaattccgctatcggatcggcctgatctacctcgatctaaacgagcaggacgcggtgctggcgctgtcaccgctggccgggcgcagccgctttgcgccgttttcgtttcgggagagcgactacctcaagacctataccggtcgtggtgtgcgcctgatcgatgcggtgcgccaacaagtggctgccgccattggtcatgagccacaaggcgcggtctgcctgctgactcaggcgcgcagttggggcctgtcgttcaacccggtgagtttcttttattgccacgaagccgacgggcaactggcggcgattgtctgcgaggtcaccaacacgccgtggcgcgaacgctatcactacgtgctgccggcgcgcacgccggtcaatctgcaggattttcatcagcacttcgccgtggccaaagcctttcacgtttcgccgtttttgccgcgcgatctcgaataccgcatgagcttcagccccgccgcgcaaaccctcggcgtgcacatggccgactggcagggcgagcaaaaactgttcgacgcgacgctcaatctgcaacgcgaaacccttgatcgccacagcttgcaccgtcacttgcggcgctttccgtggatgaccgcgaaaaccgcgttggcgatttactggcaagcgctgcgactgctgctcaaacgcgctccgatctttgctcatcagactgccgacggcagctttcaaaccgccactgtgcctcccaaggagcaccgccatgaaatcctctagcctgtcggtcagtcggctcagcactaacggtttgaccggatcgctgctgcgccgaggcgtattgcgtcaactcgctcagctcaaacacgggcaattgatggtgttcgaagacggcgaacaaatgctcttcggtacgcccggcagtgcgctgctgggagaaatccacatcaccgatccagcagcctgggggatggttgccagcagtggctcgattggcgccggcgaagcgtttattcatggctactggagttcgccggatctgacggcagtggtgcgcgtgtttgtcagcaacctggaagtactcgatgccatggagggcggcctcgcccgcctcgggaggccattggtgcaaggcctgcactggctcaatcgcaatacgcgcaagggctcacagaaaaacatcgccgcgcactacgacctcggcaatgacctgttcgagcagtttctcgacccgaccatgatgtattcggcagcgcagtttctgacgcccgaagacacgcttgagcaggcgcaactgaacaaactcgaacggatctgccagaagctcgcgctcaagcccagtgaccatttgcttgagatcggcaccggttggggcagcatggcgctttacgcggcgcaacattacggctgccgcgtcaccaccaccacgctgtcgaaagaacagtacgcctttaccgcacagcgcatcgaacaacttggattgcagcaacaagtgacgctgctgctcaaggactatcgcgacctcaccggcgagtacgacaaactggtgtcgatcgagatgatcgaagcggtcggtcatcgctttctgccgacctacttcaaacagtgcgcgcacttgctcaagagtaacggcctgatgctgattcaggcgatcaccattcgcgagcaacgctatgagcaggccaagcgcggcgtcgacttcatccagcgctacatcttccccggcggtgccctgccctgtgtgcagaaaatgctcgaagtggtcggccgcgacaccgacatgaacctgctgcacatggaggatttcggcctgcactacgcgcgcaccctgcgcctgtggcacgagaacttccgccgcgcccatggccgtttgagcgaattgggctacgacgattatttcctgcgactgtgggagttctacctgtgctactgcgaaggtggtttcctggaacgcaccatcggcaccgcgcaattgctgctggccaaaccggccgcgataactgcgccgctgctcggacgcttcgatgcttgagcgtgtggccaatgccgtgctgttccagatcggctggctgacgtgcgtgctcggcggcaacagtttgtggttgttgatcgcgttagcggtgctggtgatccatctgcgctggatcagcagttgggcggctgaaggccgtttgattttgagcgtggtgattgtcggcacggcggtggacagtgtgttgcgtggtgtcggggtattcgagtttcaggatcagtcgccactgattccgttgtggctgatgctgctgtgggcgctgctcgcgacgacgctgcgccattgcctgcaatggagtgcccggccctggtggctggcgagtgtgcttggcgcagtcggcggagcactgtcgtattacgctggcggacgcctggccggggtgcaatttccctacggcgaactacccacgctgatcggtatcggcctgctctgggcgctgctgtttccgctgctgcatgggatggcgcgacgactggcacattgagcgtctgtcagacctttcacacgcacagcagcgactgccttacactgccgccatgaagaccattccccaccaacaaatcacggaaccggcggtcacttgttcgacctgcgcggcgtgctgctgtcagctcgaagtgatgctgatcaccgacaccggcgtacctgatcgctttatcgataccgatgagtggggcggcgaagtgatgctgcgcctggacgacggctggtgcgcggcgctggatcgcgacacgatgatgtgcacgatctatgaaaaacgcccgttgatctgccgcgagtttgagatgggtgcaccggagtgcattgaagagcgccagggcatcagtactgcctaccgctgatttttgagcatcacaaaaaccaatgtaggagtgagcctgctcgcgatagcggagtgtcagtcaatatttgtgtgactgacactccgctatcgcgagcaggctcactcctacaggggttatgcgtacggcttagagcggcatcgtgtaatgcagcgcgtaactttctacgccgtcgttgtcactggccaggccagcgttggaatagtgcgtggcacggatcccgacttcatgcccgccattgaagcgcagaccaaaaccgatacggtcttcgaactggaaagaaccgccgaggttgttgctttcatacttggtgttggagaacgcagccacaccaatgcccgcttcgatatacggtttgaccgactgtccggcaaactcgtaaacaaacaccggcgagaacgacaggctgttgttgctggaggtcttgtcgccttcccaataggtataggcaccgctccagtaaccggtcaggcgaccgacgtcgctctgcagccagctcttgtcccaatcgaaattcatgcccaagcggtacgtcatggtcgaatcgctagtggcccccaccgcaaactcaacacctgccgcttgtgcagtaacactttgccccatcagtgcggccgcaatcgcggccaagcagaatagtcgcttcacgttgaaacttccttttccggaacgatcgtttggttttctagataactcttcgctatagaagctggcgcctgcttagaagttcagctgattttttagttatttcacaatttttttacaagtcgaagttttgcacttcaccagcgttttgtccgagcagtggcaggatgtttttaaagtactcaggatcggcgctggtccagaatctgactggttggttcgggccggcagcgagcaaatcacgctcagccaaaagccgctgaagttgccgcgctacagcagcaccggtatcgatcaggctgatgtcctcggggatcatcgacttaagcatcggccttagaaagggatagtgggtgcagccgagaatgatcgtgtcgcagccgctggccaacagggggtcgacataactttgcagcagcgcgcgcaactcggcgctgtgcagatcgccactctcaatcaattcgaccagaccgggacacggctgggtgatcacccgcacgtcagtggcgaagcgatcaagcagcgccgcgaacttggcgctttgcaaagtcccggtggtggcgagcacgccgactactccgctgcgggtcgcggcagccgccggtttgaccgcaggctccatgccgaccagcggccaatcgggaaaatcacggcgcagatcggcgacaccggcaacggtcgcggtattgcaggccagcaccaacgccttggcgccctgctcgcggaaaaacccggccatcacgctgcagcgctggcgaatgaattccggggttttctcaccgtagggaatgtgcccgcaatcggcgacatagagcagcgattcattgggcagcaagcgctggatttccgccagcaccgacaagccgccgacgccggagtcgaacacgccgatcggcgcttcacgcatggcgcgaaccacagacgctgcaacccggatcacgcttgacgcgcagctcacggaaacgcgagcccagcgcatcgatcagtaacagacgcccaaccagcggctcgccgaaaccgaccaacaccttcaacgcttccaacgcctggagactgccgaccagaccgaccagcggcccgaccacgcctgcttcgctgcaggtcagttcggcttcgctgccgtggccgtacaagcagtggtagcacgggctctcggcgcgacgcgggtcgaacaccgacaactgcccttccagacgaatcgccgcgccgctgaccaacggtttgcacgcagccacacacgcagcgttgaccgcttcgcgggtggagaaattatcggagcagtcgagcaccagatccaccgctgccacggctgcggcgagagaatcctcgtccagcgcctgacgatgggcgatcaattgaatctcgggattgatcgagcccagacgcttgagcgccgagtcgaccttgctcatgccgacgctgtcggtgtcatgaatgatctggcgttgcaggttggtcaggtcgactgtgtcgaaatccgccaaatgcaattcaccgacacccgccgccgccagatacaaggcaaccggcgcaccgagcccgccgaggccgatgatcagcacgcgactgtccttgagcttcagttgcccgtcgatgtcgatgtgttgcagcagaatctgccggctgtagcgcagcaattcctgatcattcagcacggcaggcgccccagactgatgcgttgatgaccgcccagatcggtgcggctgtggacttcttcaaaaccgcgcgtcagcagcaagtcacggacggcttcggcttgatcatagccatgttcgagcatcaaccagccagcggcctccagatgatccggggcctgatcgacgatcaagcgcagatcgtcgagcccgtcctcaccagcaaccagcgcgctggccggttcgaagcgcacatcgccctcgaccagatgcggatcggcggcggcaatgtacggcggattgctgatgatcaactggaaacgctgaccttcaagtgcgctgaaccagtggctgctcagcaccgtggcgttgttcaaatgcaggcgctggcgattgcgttcggcgagggccacggcttcgagcacgcgatccaccgccgtgactttccacgccggacgttcgctggccaacgccagggcaatcgcgccgctgccagtgccgagatcgagcactttcgccggggtcgcaggtagcaattccagcgccgcttccaccagcaactcagtgtccgggcgcgggatcagcgtgtgtggcgcgacttccagatcgagtttccagaaaccctgctgaccgagaatgtaggccaccggctcaccgccacgacgacgttgcaagtactcggcaaacgtcagcgctgcttcactcggcacaatgcgctcgggccaggtgtggagaaaactgcgcgacttgcccaacgcggcggccaggagcaattcggcatccaggcgtgcggtgggcgagtcaggcagttcggctgcgcgcaacaggctggcaatgatggtcatttattcacctatcgcggcgagttggtcagcctggtattcggccagcaaaggctcgatcaccgcctcaacgccaccggcaagaatttcgtccagcgagtacagggtcaggttgacgcgatggtcggtgactcgaccctgggcaaagttgtaggtgcgaatgcgctcggagcggtcgccggaacccaccagcaatttacgttcgctggcgatcgcattcgccgccgctgcggtttgctgatcgttgagcttggccgacagccaagccatcgcccgcgcccggttcttgtgttgggaacgttcttcctggcactcgacgacggtaccggtcggtatgtgcgtgatgcggatcgccgagtcggtggtgttgacgtgctgaccaccggcgccggaggagcggaatgtatcgacacgcaaatccgccgggttgatctcgatggcttcgcgctcgtccggctcgggcagcaccgccacggtgcaggccgaggtgtggatacggccctgggattcggtggcgggtacacgctgtacgcggtgcgcgccggattcgaatttcagtttgccgtaaacattgtcgccttcgatgcgggcgatgacttctttatagccaccgtgctcgccttcgttttccgacaggatctccacacgccagccgcgacgctcggcgtaacgcgaatacatgcggaacaaatcgccggagaagatcgccgcctcgtcgccaccggtgccggcgcggatttcgagaaacacgttgcgcccgtcgttgggatctttgggcagcaacatgcgctgcagatcggcttccagggtgatgagcaattccttggcttcgcggacttcttccacagccatttcacgcatgtccggatcgttgtccttgagcagcgcctgcgcgccttcaagatcgctttgtacgccgagcagctttttatagccttgcacgaccggctcgagttcagcgtattccttggaataagcgcgaaatttggcctgatcggaaatgacttcgccgtcgccgagcaacgcggtcagttcctcgaaacggtcctggaggatgtccagcttattgagcagtgacgctttcattgcggttttttatccgaaaagctatccggtgagccctcgagggcaaagagttcctgggccatggccagcgcatcgaggcggccttcggcagaaagctttttcaactgcacgctgggcgcatgcaacagtttattggtcaggccacgggccagttgcccgagcacctcttcggcgttgccaccgttggccagcaggcgcagggctttttgcagttcctcgtcgcgcaggcgttcgctctgttgacgataggccttgagcacatcgaccgccgccagctcgcgcaggcgcaccatgaaatcatcggcgccgaccgagaccatctcttctgccgcctgggctgcgccctgacgactcttgaggttttcggcgaccacttcgtggagatcgtcgacgctgtagaggtaaacgtcgtccaactcgccgacttccggttcgatatcgcggggaacagcgatatcgaccatgaaaatcggcttgtgcttgcgcagcttcaaagcgctttccaccgcgcccttaccgagaatcggcaactgactggcggtcgaactgatgacgatgtcactgcgcaccagttctgccgggatgtccgagagcagcaccgcgtgggcgccgaactgctcggccaacagactggcgcgctccagcgtgcggttggcgacgacaatgcgcttgacgcccagctcgtgcaaatggcgggcgaccagggtgatggtctcgcccgcgccgatcagcaaggcttggctgcgctgcaaatcactgaaaatctgtttcgccaggctgaccgcggcaaacgctacggataccgggttttcaccgatcgcggtgtcggtgcgcacctgtttggcggcattgaacgttgcttgaaacagccgccccaacagcgggccgatggtgccggcctcgcgggccacggcgtaggccgatttcatctgaccgagaatctgcggttcgcccagcaccagcgagtcgagcccggaggcgacgcgcatcatgtgacgaactgccgcatcatcttcatgcacataagcactcgcgcgcagctcatcgaggcttaaatggtgatagtcggccagccagcgcagcacgatatcggcagaaagctgatcctgttctatataaagctcactgcgattgcaggtcgagaggatcgcagcttcgcggctgtcggtcagtcggcagagctgctgcaaggcttccaccaactgctctggcgtaaaggccacgcgctcgcggacgtctactgaagcagtcttgtggttgataccgagtgcaaggaaggccattcaaagtcgctgatggtgacgtgaagccggcaattgtcctacttcgccagattcagaacaactattggatatctatcgcccttattgtatccaccttatgctgcgatccattctcgttcatgtacacaccaccccatgtaggagctgccgaaggctgcgatcttttgactttgttttttgaaatcaaaagcaagatcaaaagatcgcagcctgcggcagctcctacagggcgatcagcgtaaattgcctgagcggttatgtttggccgaaagcttgtgtcatgatgatccgaccgcaggttagtcgtccttctcctatatgaatagatcttccgcgttgctcctcgcttttgtcttcctcagcggctgccaggccttggctcccgtgtcgccggacggtacgccgccggttgaagacaccacgcccgcgcctgaaaagcccaaggtttacagctcgttcagcgaggaaaccgttttcagcctgttgagcgccgaactcgccggccagcgcaatcgtttcgacattgctctggacaactacgtgacccaggccatcaatacccaggatccgggcgtctccgagcgtgcattccgcatcgccgaatatctgggcgccgatcaaccggccctcgataccgcgctgatctgggccaaaaacgcgccggacgatctcgaagcgcaacgcgccgccgccgtgcaactggcccgtgccgggcgctatgacgactccatggtttatatggagaaagtcctgcagggcaaaggcgacacccacttcgacttcctcgcgctgtcggccgccgataccgatcaggaaacccgcaacggtctgatgaaaagttttgaccgtttgttgcagcgtcatccgaacaacagccagctgattttcggcaaggcgctgctcctgcagcaggacggcgacaacaaggccgcactgagcctgctcgaagaccacccgccggaagaaggcgaaatcgccccgatcctgttgcgtgcgcgcttgctgcaaatcatgaaccgtggcgacgaagcgttgcctttgctgcaaaaaagcatcaagaaatacccggacgacaaacgcctgcgcctgacttacgcgcgcatgctggttgagcaagaccgcatggacgacgccaaggccgagttctccagcctggttcagcaatacccggaggacgacgaactgcgttactcactggcactcgtctgcctggaagccaaggcctgggacgaggccaagggttatctggaagacctgatcgcccgcgaaagccacgtcgattcggcgcacctgaacctcggtcgcattgccgaagaacgcaacgacccgcaaggcgctcttctcgagtacgcccaggtcggcccgggcaacgactatctgccagcgcaattgcgtcaggccgatatcctgatgaacaacggcaagaccgctgaagcgcaaagcaaactcgccgcccagcgcgacgagcaaccggattacgcgattcagctgtacctgatcgaatcggaaaccctgtcggccaacaaacaggacgacaaggcctggaaagtcttgcagacagccttgcagcagtacccggacgatctgaatctgctgtatacccgggcaatgctcgcggaaaaacgcaatgacctggcgcagatggaaaaagacctgcgcctgatcatcaaacgtgatccggacaacgccatggcgctgaacgccttaggctataccctgtccgaccgcacaacccgctacgctgaagccaaagcactgatcgagcaggcacaccagatcaacccggaagacccggccgtactcgacagccttggctgggtgaattaccgcatgggcaatctggacgacgccgagaaatatctgcgtcaggcgctggagcgttttcctgaccacgaagttgccgcccacctcggtgaagtgttgtggaccaagggcaaccagcgcgaagccaaacaaatctggggcaaattcctcaaggatcagcccgacagcaccattctgcgcagcaccatcaagcgcctgaccggatccgagactctttaactcatgtttttgcgccacgttattgttttcagcttcatcgccctgctcgccggctgctcgggttttggcactcgtgaatcggtcgagggccacggcagtccggctcaatgggctgcgaacaaacagcaactgaccggcctcgacggctggcagatcgacggcaagatcggcatccgcgcaccgaaagattccggtagcggcacgctgttctggctgcagcgtcaggattactacgacattcgtctgtccggcccgttgggtcgtggcgctgcacgcctgaccgggcgtccgggcaaggtgtcgctggaagtcgccaaccagggtcgctacgaatcgcagtccccggaagccctgctcgaagaacagctcggctggaaactgccggtgtcgaatctggcctggtgggtgcgtggtctgccagcgcctgatagcaaaagtcgcctgaacctggacgccgacagccgtctggccaacctggaacaggatggctggaaagtcgaatacaccgcttacaccgaacagaatggttactggttgcccgagcgcatcaagctgcacggcaccgacctcgacgtcacgctggtgatcaagacctggcaaccgcgcaagctggggcaataacgcatgaccgctgcacgcctgaccctgccctcgccggccaaactcaacctgatgctgcacattctcggtcgccgtgaagacggttatcacgagttgcagacgctgtttcagtttgtcgattacggcgacgaaatcacttttgccgtgcgcgatgacggcgtgattcagctgcacaccgagtttgccggcgtgccgcatgacagcaatctgatcgtgcgcgcggcgaaaatgcttcagcaacaatcgggttgtacgctgggcgtcgacatctggatcgataaagtgctgcccatgggcggtggcattggtggcggcagttcaaatgcggcgaccactttgctcggtctgaatcatttgtggcagttgggttgggatgaagatcgcctggctactctgggcctgacgctgggtgccgacgtcccggttttcgtccgtggtcacgcagctttcgccgagggcgtgggcgagaaactcaccccggtggatcccgaagaaccgtggtatctggtgctcgtaccgcaagtctctgtaagtacggcagaaattttttccgatcctttgttgacacgtaacacgccgcccattaaagtgcgccccgttcccgagggaaacagtcgaaatgactgcttgccggtggttgcaaggcgttatccagaagtacgtaacgcattggatttgttaggtaaatttaccgaagcaaaactcaccggaactggaagttgtgtgtttgggggcttcccaagcaaagctgaagctgataaagtctcggcccttctgacagagacccttacagggtttgtagccaaaggcagcaacgtttcgatgttgcaccgcaagctgcaaagtctgctctaaaggaaccaggtgctcggcacttgatgcaacagatacaggggcgtcgccaagcggtaaggcagcaggttttgatcctgccatgcgttggttcgaatccagccgcccctgccattttctatactcatccaggttaccctcagcctctaggtactgcgcgtgtccaagatgatggtctttacggggaacgctaaccccgatctggctcggcgtgttgtacgtcagctgcatatccctctcggtgacatctctgtcggtaagttctccgacggcgaaattacagccgagatcaatgaaaacgttcgcggtaaagacgttttcattattcagccgacttgcgctccgaccaacgataacctgatggaactggtagtgatggctgatgccttccgccgctcctcggctactcgtatcactgctgttattccttattttggttatgcccgtcaggatcgccgcccgcgttccgcacgtgtggctatcagcgcgaaagtcgttgctgacatgcttaccgtagtcggcatcgaccgtgttctcacggttgatctgcatgctgaccagattcagggtttcttcgatattccggtagataacatctacggctccccggttctggtggatgacattgaagatcagcgcttcgaaaacctgatgatcgtttccccggacattggtggcgtcgtgcgtgcacgtgccgttgccaaatccctgggcgtggatctcgggatcatcgacaaacgccgtgagaaagccaatcactctgaagtgatgcatatcatcggtgatgtcgaagggcgtacctgcattctggtcgatgacatggtcgataccgccggcactctgtgtcacgcggccaaggccctgaaagagcatggcgcagccaaggtcttcgcctactgcacacaccctgtgctgtcgggtcgagccatcgagaatatcgaaaattccgtgctggacgagctggtggtgaccaacaccatcccgctgtccgctgcagcacaagcctgtgcacgtatccgtcaactggatatcgcaccggttgttgccgaagcggttcgccgcatcagcaatgaagaatcgatcagcgcgatgttccgttaagggccctgcccttctcgaaatgtctcgttgacgaaaagcgccccgccccggcattcctgccggggcggggcttttttgcccataccgtgtttggcgctggtcgcaaacgccactccggtcatggctattttggagatacaaaatgaacgattttactctgaatgctgaagtgcgttccgacctggggaaaggtgcgagccgccgcctgcgtcgtctcgccgctctggttccagctgttgtttacggtggcgaaaaagcccctgaatccatcagcatgctggccaaagaagttgccaaactgctcgaaaacgatgctgcctacagccacgttatcgaactgaacgttggcggcaaaaagcagaacgtcatcatcaaagctctgcaacgtcacccgtccaagggtcacgttctgcacgctgacttcgtacgcgtcgtagccggccagaaactgaccgctatcgtgcctgtgcactttgtcggtgaagaagctccgatcaagaaaggcggcgagatctcgcacgtcctgaacgaaatcgaagtaacttgcctgccgaaagatctgcctgagttcatcgaagtcgacctgtcggctctggaaatcggcgcaatcgttcacctgtccgacctcaaagcccctaaaggcgttgagttcgttgcactggctcacggtgacgacaaagctgttgcaaacgtacacgctccacgcgttgctccagaagctgaagaaggcgcagcagagtaattcactctgtcatgcctgagtgagcaagtaacatcgcggactggaacgtagcgagaaagcgggcgagaacgcggagtttacatccatggtaaatgagcatttttcgtccactttcgccgctttgcctgatcgcggcgatgttactcaccactcaaaggaagggcccctatcgtgactgccatcaaactgatcgttggcctgggaaatccaggcgccgaatacgaccagacccggcataacgcaggggccctttttgttgagcgcatcgcccacgcacagaatgtgaatcttgtggccgatcgcaaatatttcggcctgaccgggcgctattcgcatcagggtcaggatgttcgtctgctgattcccaccacctatatgaaccgcagcggccaggccgtggcggcactcgccggtttcttccgtatcaagcctgaagaaatcctcgtggcgcacgacgaactcgacttgcctccgggcgttgccaagctcaagcagggcggcggccatggcggtcacaacgggttgcgcgacatcattgcgcaactgggcaatcagaatacgttctaccgcctgcggcttggcattggccacccgggcgttgccagtatggtttcaaatttcgtcctgggtcgtgcgccacgcgccgaacaggaaaaactcgatgccagcatcgactttgccctcggcgtgctgccggatatcctcgccggtgaatggaaccgcgcgatgaaaaacctgcacagccagaaggcctgactctactccgaggggaaacaccatgggattcaattgcggcatcgtcggtctgcctaacgtcggcaagtccaccctgttcaacgccctgaccaaatccggtatcgcggccgaaaacttccccttctgcaccatcgagccgaacagcggcatcgtgccgatgccggatccgcgtctggaagccctggcggccatcgtcaatccgaagcgcatcctgccgaccaccatggaattcgtcgacatcgctggcctggtagccggcgcctcgaaaggtgaaggcctgggcaacaagttcctcgccaacatccgcgaaaccgacgcgatcgctcacgtcgtgcgctgcttcgaagacgaaaacgtgatccacgtttccaacagcgtcgatccgaagcgcgacatcgaaatcatcgacctggaactgatcttcgccgacctcgacagctgcgagaagcaactgcagaaagtcgcgcgtaacgccaagggcggtgacaaggacgccgtggttcagaaggctctgcttgagcaactgatcgcgcacttcaccgaagccaaaccggcgcgcagcctgatgaagaacatgagcgctgacgaaaaagcggtgatcaagggcttccacctgctgaccaccaaaccggtcatgtacatcgccaacgttgctgaagacggtttcgagaacaacccgcacctggacgtggttcgcgccatcgccgaagaagaaggcgcgatggtcgttccggtgtgcaacaagatcgaagctgaaatcgccgagctcgatgacggcgaagagaaggacatgttcctcgaggccctgggcctggaagagcctggcctgaaccgcgtaatccgcgccggctacgaaatgctgcacctgcagacctacttcaccgccggtgtcgaagaagtccgcgcctggaccgtcaaagtcggtgccaccgctcctcaggccgccggcgtgatccacaccgacttcgagaaaggcttcatccgcgccgaagtgatcgcctacaacgacttcatccagtacaagggcgaagccggtaccaaagaagccggtaaatggcgtctggaaggcaaggattacatcgtcaaagacggcgacgtgatgcacttccgttttaacgtgtaagcgacacgccgaagaaaaagccgcgtttgatacgcggcttttttgtgcctgaaatattttccgccacgccaccaattccctgtaggagtgagcctgctcgcgatagcggagtgtcagtcaattcaaccgtaactgacacaccgctatcgcgagcaggctcactcctacaatgggaaatgtgtgaatcaggttttttttgtccgcggcaggaaaatcgccagtacgccaaatagtggcaggaacgagcacaggaaatacacgtactcaatcccgtgaatatccgccagatgccccagcaacgccgcgccaatcccgccgaaaccaaacatcagaccgaagaagattccggcgatcatcccgacattgcccggcaccagttcctgcgcgtacaccacaatcgccgagaacgccgacgccagaatgaagccaatcaccacgctaagaacactggtccagaacagatcaacgtggggcatcagcagcgtgaacggtgccacgccgaggatcgagaaccagatcaccgctttacgcccgatcttgtcaccaatcggcccgccgaagaatgtccccgccgctaccgcccccaggaacaggaacaagtgcaactgcgaactggccaccgacaggtcgaacttctcgatcaggtaaaacgtgaagtagctggtcaggctggccatgtagaaatatttggaaaacaccaacagccccagcaccaccagcgcactggtcaccctgcccttcgacagcccgtgagtcgccgcctgaccggccttgagcttgaacagattgaggtgatgggcgtaccagcggctgatgcggtacagcacgaacagcgcaaacaccgcgaacaaaccgaaccacgccacattgccctgaccgaacggaatgatgatcgccgccgccagcaatggaccgaacgcggaaccggcgttaccgccgacctggaaggtcgattgcgccagaccaaaacgtccgcccgaggccagtcgcgcaatccgcgaggcttccgggtggaacgtcgaggaaccgataccgatcagcgccgccgccagcagaatcaacggaaaactgccgaccatcgacatcatcacgatgccaatcagcgtacagatcgaaccggccggcaacagccacggtttcggatgccggtcggtgtgataaccgacccacggttgcagcagcgacgcggtcagttgaaaggtcaaggtgatcaggccgacctgagtaaaggtcaggccgtaattggccttgagcatcgggtagatcgacggcagcaccgactggatcagatcgttgatcaaatgcgccagcgccaccgcgccgatgatacgcatcaccaatggactgctttggggagcagcgggcgccgaggcagcggcggtctgaacgttgctgatagccatgaaagtttccggacagcagatgggtgcacgcaggcaggtgcgtcaatgtgccatttttcggtgcgccagcgccatccccttagccagctaactaaccaaccaactgaatcacagatcaatccctgtaggagctgccgaaggctgcgatcttttgatcttgatcttaaaaacaaagatcaaaagatcgcagccttcggcagctcctacacaaagcccggattatctggacaaggtgatagcgcaacgccatggtctgaatcttgccttgcttctccccttgaacgcgggcgccttacaaaggcgaccgacaatgggaagtttcgctacagagccggcctacagagcgggcgagagtgaactttcgaggccttttagcagggcacaacatccaggtcgcacgaccgcgatgcacgccattggtgcgtggtgtccagaggagtcatggggcatgcaggctttcctttcaccggggatcaaattgctggggcgttttggcttcgcaggtaaattccagttgttgtttctgctgttcattctgccgttggccggcagcctgttgatgatcggccaggactatcgcgacaagctcaatctgatttccggcgaacgcgccggcgtgcgccagttgctcgcgctggatgcgctggataacctgctcgccgcgcaacgtgaccgcgctgcccgctggcgcgccacggaaaccaatcgccagccgacaccggccactctcgccgccatgggcgccttcgacgcggtgcaaccagcggttctgcaagccaccacagatttgggcaacgcgctgaaaaacgaaggtgccgaaggcgaaaccctcagccgttatcaagcgctgcaaaccgcgctcaacggcctggactcgaaaagcctcagcggtgtcggttggtggccggacggttacgaccgtttcaccaacgccctcagcgccctgcaagcgttgcgcgaacagatcgtcatggacaatcgcctgaccctcgcgccatggctggaaacctatctgctgacgcagatctcgacgcaacacgcaccggacctgatcgagcgggtcggacgcctcgctgcggtcggccaggcttcggtcgtctctggccaattcaccctgcaaagccgtttgcagttgcgtgacctgcgcagccgcatcggcgacgcccgcgagcaactggtgaaaaccgccacgctgctcgaagcacgcctgccgaaagatcagcagagctgggccagccaataccacgacagcctgaaacacctcgacagcggtctgaaggtgctggatgacggtgtgttcggcggctctatcaatctcaaaccggaagaattcgaacgcagcctcgatgcgctgttgaccgacctcgccgccctgcgccagcaatcgctggtgtcgctggatctgcgcctcgacgcctaccacagctcagcaatccgacagttcatcctcgtcgcagcgatcttcggttgcctgctgctcgcggcgttgtatttgttcgtctgcctgcaagcctcgatccgccgcagcgccagcggaattactttgctggccgaagccctgcgcgatggcaacctcagcctgcaagtaccggtggtgggccgcgatgaattggcggcgatcagcactgcgctcaacgttgccgtggtgcaactgcgcaacagcatgcttggtgtcgatcacgagacctcgcagttgagcaacgcggtgcgcagcctcaacgagcattccagcggcgccctcggcgaagtcgaggcgcagcagttgcagatcagccagatcgccgctgctgccacgcaattggccgcgacatcgcaaggcgtggcgcaaagctgcgaacaggcctccggcagcgcgcagcacacccgccgcatcgccgccgacagcagccgtgacagccaacgcaccacggcgagtatccagcagctcaatcaacgcttgaacgagaccgctgcggcgttgggtcgggtcagcgagcaaggtcagcagattcaattggtcgtcgacacgattcgcggtgtcgccgaacagaccaatctgctcgcgcttaacgcggccatcgaagctgcgcgcgcaggtgaacaaggtcgcggtttcgctgtggtggcggatgaagtgcgtagcctgtcgcaacgcacacaatcttcgacagcgcagattgccggcacagtcgacagcttgcgcgccacggtcaacgaagccgtgagtttgatggaagcggcgtgtggtcaggcgcaaaccgacgccgaatcggtcaccggcctcggtgaacgcctgggcgaaatcgccagcgccgtacagagcgtcactgacacgctcgcgcagatcgctacggcggtcgaggaacaggccagcaccgccgatgaagtcagcggcaatatccagcaggtcgatcaggcggccgtgcgtttgcttgaaggcgcacgcgcggtgaacctcgcggcggataccctgagtcagggcagccatgccttgagcgccaatacggcaagatttcagctgcgttgaggccctgcccggcccggattttccgggctggaggataagcggttgaaaataagaagaaatattttaaatttacgcttgacgcttttccatttcaggggaataatgcgcgccacttggctacatagctcagttggttagagcatagcattcataatgctggggtccggggttcaagtccctgtgtagccaccaagtactaaaaacggcttaccgaaaggtaggccgtttttttatgcctcgagaaaagtctcggtaatctgttattccgcagtaatcaccagcccccttcatcacgcgcactttgacgttctcgtttacctcgaatcctgcccgccgtaaccacaggccgcggaacttgatccaaggcacgggtttggcgttcaaacctctttttcttcgtcgctcgttttggtcgctgcctgtgcgatcagggcgtcgagcatctgcgtaatgaccctctgttggaccttcgaaagcgccttgatggactgcagccgtccccatgcaaagcgaaagactacaagcacgaaacaccccggcttcagctgaatcaatcgccaatcaacaggccgagagagcgctgtaggaaacaggtccgattcaggtacgaattggatttttcgtaaaaccaagcgcctgaaacttgccccaccggtttgcccgaattccccattgaccgacaagcttccctggctcgattcaaagccatacagggagttggcatggctcgattcaaatcgctcttcgatgaagattggccctggaagcgcgactacggcggcgcttcatggggcgggtggtttccacccaaagcgccggagccggtgtacatcgaaaaggatgaatggccaacgcccaagcgccgcgaagatcaggtgttcgccaagtcctgcacggtggataactggtgccgaacggacgccggtacggcacccgaacccgccagcaacttcggcaagatcatggtcgccggcgccatgctcttgccctctgccagcaccgctgtcgcgacggcaataggtgccgatctggccttggggcgtttggcgggcggcggcattttgcaacaacgcctcaactgggcaattcgcggcgctgctgggccggccagcgtgttcgtcctcgggatgctgccgacccgcatgggtgacggcacgctgcacaccgacgaacaactgcgccgcatgagccgcgcccccactcgtgtgcgcttccagtttcgacgtaatactgaaggagtcatgcaggtttacggcatccactccggcgcttcgggcgatgactcggtgcgcactgtcaaagtcgagtggaacagcgacaagactgcgatggaggccaagctcaacggcatcacgattttgtggacgccacaacgcgggccactcggttcgatgccgccgctggtttatcccgaacacggcgagcaactgaacacgatccttgttcatccgattcccgagaacacggatacccagatagaaggcctgcccggcgaggacattactgccgaggattgtattctggtgttcccggcggacactgggctgaagtcgctgtatgtggttttttcgaggccggccagactgacgccaggtacggtgacgggtgttggtgaggatgtgtcggggatatggcttactggggcgggaacgggggtcggcgcgccgattccgacacggattgcggataggcttagggggcgggagttttcaagcttcgatgccttcagaaaggcgttttggactgaggttgtgaatgatccagaactggctgagcaatttaaaccgcagaatattgcgcttatgcgcagtggcagcgcacctcatgcccggtatcaagatgctgtgggtaaaagaaaaacttacgaactacatcacgttgtatgggtatcggaaggtggtgatgtatatgacatcgagaacttaagggtcagcacgccaaaaaatcatatagatattcaccggaaataacctcatggcaaataaaattactgattacaccgaagagcaattcattagcttattgcaggaaatattcacttccaatggggatggcacgccagagatggtgttggcggatctattggataaattctgtgaactcgccgagcaccccgccggtactgacctgatttattggccggaggatgacgctgattgcacccctgaaggcatcaccgaaaccgtaaagaaatggcgcgccaccaatgagctacccggattcaaacggtaattcaatccgcccatttaaaccgaccattgcatgacaaaaatatctgactacacagaagctgatttcgtcgaatttctaaaatccgtactagccgccaacaccagccccgatgaaatacttgatccgctattactggagtttgcgcgtctatcagaacacccggcgggatctgatctgatttactggccggaagatctgagcaaatccctaacggccgaagaaatcaccgaaacagtaaagcggtggcgcgcggcgaatggactgcctgggttcaagcaataagtacctatacctcgagatgatcaccgaacttgtgtcgaggggataaacctcctcaccataacgctatgcctgacctactcaggtttctctgtcgacagggctgccaaccccttcgcccaaatctgccgagtccgcagccccaccatcgcccgccaatccggatcaaccggataaaactgctcgagcaaattcactttgatccccctccccgtcgcatccagcggatcgccatgcaaatgcagccaatggtcatcgcgcaaatgccgatgcacatccggccccggataagtcccgcactcgatcacgaacggcatcaactgcacgtccggtaaagcattgagcaacgcctgcgaggtgtacccggtagccgtcgctgccacaccggtttcgctcaaggtgtcggcgcccgtgtgcagggtgtaaagccatggaccataaatcgcctgcgcttgcgcaagtgccgggtaaggcgcctgggtgatggtcagcaacatcggatggccgtactcaccggcgccggtgtgcaggtcgaaacacatcacggtttcagcgccagccagatgcgtttcgatgatttgctgcaaggtgcgattcgaccagctcggcgcacggccgccgtaaaacaggccgtcgggatggctgtgctgaccgccctcgacaatcgacatcaccgccggccagccgtgttcgttgatctgcgcatcgagcaagacatcggcgcgttggcgctcggggccgtgcaaatcggtgcaggcgtagatttcatgaagtgccgcgtaagcgcggttatctgggagaggcccggtgaaatccagatgattgcggttgaggtcgatgttgtcttcgttgacccggcgtaaccacgccgtgccccatgggttgatcaggtgaaccatgaccaccgcaacatccttgggcagcgaaccgggttcgaaggttttcagccattcgatctggcaatccgagccgtaatagccctcgaccccgtgcgtaccgctgagcgttaccagacgacgtttggcctgcggatcgccgagcacggcgacgtcggtgctcagcggttcgccgaatggcccgcagcgtggatgtgcgtaggcggtgagcgtgacgccggcggcattggcggcggcgagaaactgttcgcgttgattgcggtaactggcttcggtggggaactcgctgtgcattcttggcctcttgtgatttttatggtttgacctctgtaggagtgagcctgctcgcgatcgcggtgggtcagtcagcaatgatgttgaatgtgatgacgctatcgcgagcaggctcactcctacaggggatgctggtgctctataaatttgagcttgaccctagcgaacatccgccccgaaaagaaagacaaaaatgcccaccggtttgcgtcgcgaccgagcggtcgataaagtccctgagacttttatcccacggacggagagcccgcgtgttttcagccttgcccttgagccgctttcgcctgccagccctgacgctgatcatcagcgccctgaccctcaccgcctgcaacgccccgccctcctcgaccttgccgctggccccggaagctgcgtccggtttccgtaccgatctgcaaacccgtcacgccagtaaacacatggcagcggctgccaatccattggctgccgaagccggtcgggagatgctgcgtcagggcggttcggcgattgatgcggcgattgcgatgcaagcggtgttgacgctggttgagccgcagtcgtccgggatcggcggcggtgcgatgatcgtgttgtgggacggcaaacaggtgcgcacgtatgacggtcgcgaaaccgcaccggccggggcgaccgagaagctgttcttgcgtgctgatggccagccgatgtcgttcccgcaggcgcagattggcggtcgttcggtcggtacaccgggcgtgttgcgcgcgctggaaatggcacataaacaacacggtcgcctgccctgggccaagctgtttgaaccggcgatcaaactgtccgaacaaggtttcgcgatctctgcgcgtttgcactcgctgctggaatcagatcccgtgatccgcaaatcacccgacatggccaagtacttcctcaacgccgacggcagcgtcaaagccgtcggcacacgtctgcaaaacccggcgctggccgccgtgctcaaacgcatcgccaatgaaggcccggatgcgttgtacaaaggcccgatcgccgaagaaatcgtcgccaaggtgcagggtcacgccaaccccggcagcctgtcgctgaacgatctgcagcgctatcaggccaaggaacgcgcgccgctgtgcaccgattacaagcgctggcaggtctgcggcatgccgccgccgtcgtcgggcgggatcgccgtggcgcagattctcggtacgttgcaggcactggaaacgcgcgatccacgtctttccctgacgccgctcaaaccagtgaaaaccgacaaaccggcgggcatcgaaccggcgccagaggctgtgcatctgatcgccgaagccgaacgtctggcctacgccgaccgcgcgcaatacgtcgccgacaccgacttcgtgccagtgccggtaaaaggcctggtcgatccgggttacctcgccagccgcgccagcctgatcggcgaacgcagcatgggcagcgccaaaccgggcacaccgccgggcgtgcaggtggcctacgcgccggaccgctcgccgctgcgcatctccacctcgcaagtggtcgcggtggatgacctcggcggcgcggtgtcgatgaccaccaccatcgaagccgcgttcggctcacacctgatggtgcagggctttttgctgaacaaccagatgaccgacttctcgttcatccccgaagagaacggccagaaagtcgccaaccgcgtcgagcccggcaaacgcccgcgctcgtcgatggcgccaacgctgatcttcgatcgccacagcggcgaattcgtcgccacggtcggctcaccgggtggttcgcaaatcatcgaatacgtcgccaaaaccaccgtcggcctgctcgactggaacctcgacccacaaagcgccatcagcctgcccaacttcggcagccgcaacggcccgaccgaactggaacaaggtcagttcagcccggcgctgattcaggcgctgaaagacaaagggcatgcggtgaatgaaatcgacatgaccagcggcacccaggccatcgtgcgggtcaaggatgcgcaggggaaagcgtcgttggagggtggtgcggatccacggcgtgagggcgaagcgttgggggattgaggctaggacgcaaagagaaaaggcttaccgtgaggtaggccttttttgtggccaacagattgtgttcactcgcatcccgtcgccttttcctacaccgaaaatttgctgccacggatagagtaagtggccgttcagcaaataacactttcgggatctgctggcatttatgaacacgcaaatattagaaccgtacgtccaccgacagccaacagccttgcatcagtcccatagcgggactaggatcgcgtcatgagaattatcgctgtcagtcagctcaaaaatttttggcaacggtatccggactcagagcaaccactgttggcgtggatagatgaagcgaggaaagcaagctggtcaacgccctcggacatcaaggcacattttgcttctgcgagcattctgaaaagccgcagagtggtgttcaacatcaagggcaatgactttcgcctgatcgtagccgtggcctaccgcttcggcgccatatacataaaattcgtcggcacccacaagcagtacgatgcaatcgacgctgataccgtcgaaatggagtaacccatgaacatacgtccgattcataacgaagaagactaccgtgcggcgctcaaaaacgtgtctgcacttttcgacaacgagccagaaccgggtacccctgaaggtgattacttcgacatcatgatcactctcattgaggcctatgaagccaaacagtttccactggatttgcccaatccgatcgatgccatcaaattccgaatggaacagtcaggcctgtcagccgcggatctcgctccggctattggtcgaacaaacagggtctatgaagtgttgaatggcaagcgggcactcactttgccaatgatatggaaacttcatgagctgtttggaattcctgccgaaagcctgatcaaaccaatgaagcaaatctgatacaaattgcagcaacccagcctttgactgcagcttagcgatcagcgattagccaccagatgcgccccaaacagcaaataacaaccaccggccaagcgatcaagccattgccgcgaacgctcgtacacaccagcgattcgccggctggcgaagaacagcgccacgcagcaataccaactgaacgacagcgtcgccatggtcagcaccgccagcgccagcaacagcggcgggatgtgagctggcatggcggtggcgaagatggtggcgacgaacagtgctgacttgggattggtcatgttgcccagaaagccgcgaccataagcgccgagcaacgtttgctgcgagtcatccagcgtacccgcgacaatcggcgccttgcgcttgaactgcttgagcccgaggtagatcaggtagcagccaccggcaatcttgaagctcaggtacagcgtcggcgcggcactgaacagcgactgaatgcccaggccacccgccagcccccacaacacggttccgctggcgacgccgagcgccgcgactacgccatgacggcgggaacggctgaccgcgagttgcgcgatgttgaagaagttcgggccgggcgtgaccaccgccacggtccacaacagggccagcgacagtaacggcgccagataactcgaaagggaaagatccatgggggtatgcgcctgattgggttcgacgatgccccctaccttgcaacatcctgcaatgttttgccatcagccgtcattcagaccgctagcgtcttgccatccaccgcatcaccaatcttcagaaaatgcccgcccgccacgtggtgcaaggtgcgcaaaccgtcatgcccttcgaaatgccagcgtccgtcgctgaacacgcgttcatcggcgtgggcggcgatcacttcggcgaggaacaggtcgtactgctcgtggttgcgcggctccggcagcaaacggcattcgagccaggcgacgcagccttcaagcaaaggtgcttcaacttgttcgccattgaaggtctgtaaggcgtaagcctgaaatttgtcttgcccttggctttggctgatgtccaggcccgaggtattgccgacggtttgcacgatgtcggcctgatcgacgcacggcacgttgagcacgaaggtgccggacgcttcgagcaactggcgggtccaggtggatttatcgaggacgaccgcgactttcggtggatcgaaatccagcggcatggcccaagcggcagccatgatgttgcgctgaccgtcgtgggcggcgctgaccagcacggtcggcccgtggttgagcaaacggtaggctttgttcaggggcaccgggcggcggtgggaatcgctcatggggtctgctccgggggaaaaggagccgattgtagcgccagcatcgaaatacaggcaggtgaaaactctgtaggagctgcggcacgctgcgatcttttgatcttgatgttgatcctctgaatcaagatcaaaagatcgcagcctcgtttcactcgacagctcctacagaggctgggtgcaggtcagtgggagagttgattggcgaactggcctaccgcattcacgactttctgcgcaccgtcctgaatctcgacaatcaccgtgcccgcctcggccgccagcgccagaccttgttcagcctgaagcttgccgtcggtcatcagcgccacggcattgcgcgccatttcctggttctgtcgcaccacggtgacgatctcttcggtcgcctggctggtgcgcgaggccagttgccgcacttcgtcggccaccaccgcaaaaccacggccctgctcaccggcgcgcgccgcctcaatggcagcgttgagcgccagcaggttagtctgctcggcgatgccgctgatggttttaacgatggtgccgatcacctgcgactgctcgttcagtgcctcgataccctcaccggcagcctgcatgtgccgcgacagatcacgcattacgttgaccgcttcagtcaccaccgtggtaccgcgctgggcggtgctgtcggtttgctgcgaggtgctgtaggcaatgctcgccgcgtcggctaccgcttgttcgcggttgacctgatcagtgatcacggtggcgaacttcaccactttgtacagtttctcgttagcatcgaccaccgggttgtaggacgcctccagccacaccgtacgaccgtggctgtcgacacgtttgaagcgatcagccacgaattcgccgttgttcaaacggcgccagaagttctggtactcggcgctgttgtattcctccggggtgcagaacaggcggtgatgtttgcccttgatctgcgccaggttgtaacccatgccgctgaggaagcgatcgttggcattcagcacattgccgttgaggtcgaactcgatcacggcagtcgaacgcaccagcgcaccgatgaggttttcgtgttcacgggaggcttcgatggtgcgggtcaggtcgctggcgaacagcgaaatgtgcttgatccgcccatccgaagaacgcaccggttgcacgatcgaacgcagccacgcttcttcaccattgccacgcagcaggcgcacggcaccggcgaaatgctcgccacgggtcatggcgtttttgaagcgctggtggaattcgtcagtcttcacatgcgccgggacgatgtcttcaatcgcccgaccgatcaggtcctgactcttgtaaagcatctcggtgaggaagttctgattgaccgactgaatgcgcccgtcgggctcaaggttcagcaccagcatctcgctttccaggctttcctttacctgcacgaggctggagagttcttcacgaagagcggccagctcttgcttcaagcgtttgttgaacatgggaaagtaccgatgggcaggatagaaagcgggatgcagcctaaccatcggccttgaaaatcttttctgaagagcgtttgcgacccgtcggtcaaaaatagtgccgcgccaccgcgtcaggcagttcccgccacctgacacggtcccttgcgcggcattcgcgagccgaaatacgccgccgtcaggagacccaccacgcccatcaccgcgcagaacatcacacagatccatgggctccaaggcatcagaccgatcagtaacagcggtgtgatactcgcccaagcggcgtaggcaatgttgtaagtgaaggaaatgcctgacacgcgaatgcgcgcaggaaacaagccgaccatcacagatggcactgcgccgacaacgccacaggcgagaccggccaccgcgtatgccaagcctacccagctaccgcccatgatcaggcagccatacagcacgccgatgcccagtggcagcaacaggctgtagagcatgaccgtgcgccaggcgccaagacgatcgaccaacaacccggcgatcacgcagccgatattgagaaacacgatgcccaatgcactgagggcgaaggtgtggctggcggtcatgccaaaggttttctgcatcatggtcggcgtaatgacgacgaacaccaccaccgccgaggtcagcacgcaggtcagcaacatcgccggcagcatcgccagtcgatgctcgcgcagcaccgtgcgcagcggcagttcaacccgcgcctcgcgctgcgcttccatggccatgaacaccggggtttcgctcagccagcggcgcaggtaaacgccaatcacgccgaacacgccaccgagcaggaacgggtaacgccaggcgtaatcgagaatttccgccggggtgaacacttgcgcgagaaaggtcgcggtcaatgcaccgatcagataaccgaaagtcagcccggcctgcaaaaagcccagggcgtaaccgcgatggccggtcggcgcgtgctcggcaacgaacacccaggcgctcggcacctcaccgcccaccgctgcaccttgcaggatgcgcagcgccagcaacagcagcggtgcgaagtaaccgatctgcgcgtaggtcggcatgatcccgatcagcaggcacggcagcgccatcatcaggatgctcaggctgaagactttcttgcgcccgagtttgtcggcgaaatgcgccatcagaatcccgcccaacggccgcgccagataaccggtgacaaaaatcccgaaactttgcagcaaacgcagccactcgggcatttccggggggaaaaacaattggctgagggtcagggcgaagaacacgaagatgatgaaatcgtaaatttccagcgcaccgccaagggccgcaaggccgagggtcttgtagtcggaacggctgaacggcgcgggtttggccgcggtttgggcagtcatggcaaagaactctgaatcaggcaaaaaaccaaggcgcccatggtctacgcaaatgggcggatggacaacccgttagaccatagtcccggttttgcaaaagctgctcacaaagcaccggcagttgaattactgttgagacttggcgaatcccacagtcaaaaccctgtaggagtgagcctgctcgcgatagcgtttttacattcaacaggtgtatcgactgactcgacgccatcgcgagcaggcgaaggcctacaggggatatgtgtttcgtccgcaagaccacaataaccataaaaatccgaggtactccctgtggccgttgatatcgaagatagccgctccgcacgctttgccctgcgctgttcaagtttcgccgaacgctggttccccgattcctgggtgttcgccgcgctggccgtgatcatcgtggccgtcgccacactggccatgggcgccaagcccaccgatgccgccatggcgttcggtgacggcttctggagtctgattccgttcactatgcaaatggccttcgtggtgatcggtggctacgtggtcgccagttctccgcccgccgtgaagttgatcgaccgcctggcacgcattccgaaaaacggccgctccgccgtggcctgggtggcgctgatctcgatggtcgcctcgttgctcaactggggcctgtcgctggtgttcggcgggttgctggtgcgcgccctcgcccgccgcaccgacctgaaaatggactaccgcgccgccggtgccgctgcctatctgggccttggcgcggtgtgggcgctgggcttgtcgtcgtcggctgcgcagttgcaggccaaccccgccagcctgccaccgtcgatcctgtcgatcaccggggtgattccgttcaccgaaacgattttcctctggcagtccggcgtgatgctgctggcgctgatcgtgatctcgatcatcatcgcctacgccaccgctcccgggccgaactcggcgcgcgacgccaaggcctgcggcatcgacccggccttcaacctgcctccgctgcaaccgcgcacccgtccaggtgaatggctggaacacagtccactgctgatcattgtgctggtgctgctggcggcgggatggctgttccatgagttttcgaccaaaccggcgatcaccgcgatttccggcctcaatacctacaacttcctgttcatcatgctcggcgcattgttgcactggcgcccgcgcagtttcctcgatgccgtggcccgcgcggtgccgaccaccaccggcgtactgattcaattcccgctgtacggctcgattgccgccctgatgaccacggtcaaaggcactgacgcgcaaaccctggcgcatcacatctcgaccttcttcgtcagcatcgcctcccacgacacctatgcgctgttgatgggcgtgtactcggcgattctcggtttcttcattccgtcgggcggcggcaagtggatcatcgaagcgccgtacgtgatgcaggtcgccaatgatctgcaatatcacctcggctgggcggtgcagatttataacgctgcagaagcgctaccgaacctgatcaacccgttctacatgctgccgctgctcggcgtacttgggctgaaggcgcgggacctgatcggattctcgttcgtacagttgctggtgcacacgccgctggtgctgctgttgctatgggcgctggggacgacattggcgtatacgccgccggtcatgccgtaaagccaagcggggcaaagtcatcaggccgcgcctcgcacttttctcccgaacagctctgtatcgggctgcccgtcgcaaataatggctcagagccatcatcccgctttaccgcatcacaccctcggtaatattctgcgcgcccataaatgtttcatttttttaccaagcgcaaagggagttcgtagcaatgatcgtagggattgacctgggaaccaccaacagcctggtcgccgtctggcgtggtgatgccaccgagttggtgcccaatgccctgggtcagttcctgacaccgagcgttgtcggcctggatgatcagggccggattctggtcggccaagccgcgcgtgagcgtctgcacacccatccgcgtctgaccgcgtcattgttcaagcgccacatgggcagcgccacggaagtttatctcgccgacaaagcgtttcgcccggaagagctgtccgcgctggtgctcaaaagcctgaaagaagacgtcgagcgcgcgtttggcgaaaccgtcaccgaagcggtgatcagtgttccggcctacttcagcgacgcccagcgcaaggccacgcggatcgctggcgagctagccgggctgaaggtcgagaagttgatcaacgaaccgactgccgccgccctcgcctatgggctgcatcagcgggacaaggaaacgtcgttccttgttttcgacctcggtggcggcacgttcgacgtgtcgattctggagctgttcgaaggggtcatggaagtgcgcgccagcgccggcgacaacttcctcggcggcgaagacttcgacaccgtgctgcttgagcacttcatcagccagcagcgttcggccgcagacttccctgagcgcagcagcgtcatccagccgctgcgtcgcgaggccgagcgcgtgcgcaaggcgctgggccaggacgacagcgccgaattccgcttgcaactcggtgagcggcagtggacgcaaaccatcactcagcaacagctggcgacgctgtacatgccgctgctcgaacgcctgcgtgcgccgattgagcgggcgctgcgcgatgcgcgcatccgcgtcagcgacctcgacgaaattctgttggtcggcggcaccacgcgcatgccgctggtgcgcaaactcgctgccgggctgttcggccggttcccgtcgatcaccctcgacccggatcaggtcgtggcacaaggcgcggccattcaagcagcactcaaagcccgcgccgccgcgctggaagaagtggtgctgaccgatgtctgctcctacacgctggggatcgagacctccactcaggtcggccgcaactatgagagcggccattacctgccgatcatcgagcgcaacagcatcgtcccggtcagtcgggtgaaaaccgtgtacaccctgcacgacaatcaggaacaggtggtcgtgcgcatctttcagggcgaaagccgtctggtcaaagacaacgtggcgctcggcgaactggacatcaaggtgccgaaacgcaaggccggcgaagtagccctcgacgtgcgcttcacctacgacaacaacggcctgcttgaagcccaggtgaaaatccccctgactgggcaacagcattcgctggtcatcgagaacaacccgggcgtgctgtcacccgaggagatccagcaacgcctgcagaacctggcacagctgaaaattcatccgcgcgagcagcaggtcaatacgctgctgactgcacgtctggagcgcctctatcaggaaagcctgggcgatctgcgtgatctgatgggcgattgggcaaagcaattccagatcgccctcgactctcaggacgagcgccagatccgtgaagtgcgcactgacttgagccgacgcctgagcgaacttgatcgcaccccgtggcaataaggatcctggccatggattgctggtcagtgctgcacctgcacgatgacgctgaagctcgcgacatcaaacgtgcctatgcgcgcttgctgaaaaccttccgccccgatgaggatgccgaaggtttccagcgcctgcgcgaagcctacgaacaagcgctggcgattgcccggtggcgcgttgaaaacgctgagcctgccgacgaagaagatgtcgccgtggccacggcttccagcgcctttgccgcactggcactcgatgctgcgctggcaaacaaacatagccaaccgcaaaacaccgcgtgggattttgccgatctcgactttccgcccgtcaacccggcagcccccgagccttttgcgccgccagcgaaggatgatgttttgcctgtcgagccactgacggcggcctcggacacagaggcgtatgcgcttgaagcgcaggccgtacggcaactgcttgaggggctgtcgcccgaaaatctcgacgagcgttgggatcaggcgcaacagcaaggctgcgccaaggccttcgaaaggctgttactgcagttgtgttttgaacagccacaactgcgcagcccggtgctgaactgggccgtcgagcaacttggatggttggggccgtggcaggacgttctgatcaatgatcgccagcatgaggttctcgccgagaatctgatggccgactatcgagacaacctgcaagcgctgctcgaaagccagagcgaacgcgaatttctcaacgtgctcaaacgctacagcgcccagccgtggctgcaggtattcgatcgccgcgaacaatggcagcaaaccctgctgcacttgctcaatgacagcgagtggagcgtgccgctgttcgaccgcatcggccaactgttcggctgggatcacaacaaaggcctgcacccgcaaccggactggctctgggacacattgatcgaacgctgcaatcaggaaagtttctacgacgatctgcgcgccaaggctgaaagcgaccggatgtcggcggccgacgttcaggcggcccatctgttgatcaacccgctcaagcccctgcagcaaaagaagctgacagacgtctttgggagggatgaatggaaggcctgttacgagctctcgaacaaactcaaatggcgttttcccgacctgctcgctcgattgccctacgccgatgttttcttctggcggcgtttccttccacgtgccatcgccgccgaaacctgggtacggttatggacggcgattgccttggcgctgtgcctgttctatctgccgtccgaacaaaaaaccgccatgaacctcgtcttcattccgatgatatttgcctgcgtgccggtctggttttttcgcattgcactgagttggtgggtggtgctcacggcccacgtggtcctgccggacctgtggctcagcgagtggctgattccacgtaaatggaacccctacacgcgatggctggtgatacgccacggggttccgcagggggtcatgctgctgctgttttcgctgctgctcggcccgctgggggcgctcacttacgttggcacgatcctgatcgggcgggtccacaaacgccgtatcggttcgctcgatccagtgctgagcagccgccgtccttggctgaccgcgctgcactgggcgcatttcagtccgctgcaattgctgtttctggtggtgatgattgcgatcatggcggccagccgactcggttactcgctcactcaattcatgcctggctaatcctgcagcacccgcaagacttgtcacccaaccgtcacattaccttgctagcgtccgcccgaaacatactgaaacaattaagctaaacgggctgaacgatgaaagacgaaacagacggcactgatgcacctgaatcagacaacccgaccgacaccagtcgccgccgtttcctcggcggcgttgcggtgctcggtgtcggtgccacgctggccgggtgtggcagcgccagcgatcaaccgggcaaaccggtcgagcgcccgctgacgcccgccgagctggacaaggccctgcgcgaccaagtgaaaaccgtggtggtgatctacgccgaaaaccgcagcttcaataacctgttcggtgatttccccggtgtcgaaaaaccgctgtcagcgctcaagcctgccgactatcaacaacgggaccgcgacggctcgctgctgcaaaccctgccgcccgtttggggcggcgtcctgcagatcggcccgcaaaccctcgatggcgtgacttatcccagcgccacgcagtttcagcaaaacctgcccaacgcgcccttcgccctcaaaggtccgaacgctgaagacttgccgttcggtctggtgacccgcgatttgtggcatgtgttctatcagaatcagatgcagatcaacggtggcaggaacgacggctttgtcgcttgggccgactccggcggtttaaccatgggccactacgcccagagccgttattccctgcgcctgtgggacgtcgctcaggaattcgtgctgtgcgacaacttcttccagggcgccttcggtggctcgttcctcaatcaccagtatctgatcagcgccaccgcgccgttctatccggacgttgccaattccgtggccaaatcacagatcgccgcgctgcaaagcgatgatccggccgatccgcgtctcaagccgctggacgcatcgccggccagcgccatgaccggtccaccgcagttcggcccgagcgcattgaccccggatggcttcggcgtcaacaccctcgccccgccctactggccaacctggcttcgcgaccctgagcgcccggcgtattcgaaagcggatctgcccaacgtcatggtgccgcagacccacgaacacatcggcgacaagctgtcgaaaaacaacatcgattgggcttggtacgccggcgcttggcaagcgacgctggatcaatacaaggactccggtggcataccaaagattcctaattttcagtatcaccaccagccgttcaactacttcaagcagcaagggccggaaaacccgcaagagcgcaataaacgcctgcgtgatgccggcctgggcgacgagtcgagcagcaataaattcttcgccgacgccgaggccggccagttgcctgcggtgagtttctacaaacctcagggtaatctgaacatgcacgccggttatgccgacgtggcctccggggatcggcacatcgtccgcgcgctgaaagtcctgcgcgagagcccgcagtggcaaaacatggtggtgatcgtcacggtcgacgagaacggcggctggtgggatcacgtcgcgccgcccaagggtgaccgctggggtccgggctcacgagtaccggcgctggtagtgtcgccgtttgcacgcaagggcacggtggatcacacggtctacgacacggcatcgatcctgcgcctgattacccgggtattccagctcgaaacgctcgacggcctcaagaagcgcgatgaggcgatgatcgcccgagggcagaaaccgatgggtgacctgaccaacgccctgcattttcatgcctgaagtcgcaccctgtgcagcgctgaaaaaaactgccattgacggcttctctgcgcaacacggctgatccactatgaggcgcccccgacctatggggaacccacgctgaaaaggatctgagcatgttcaaaatcgcaggactcacgcccaccgccctgaccctcgccgcgctcacactgagcgcggccgcccacgccgatgtcgatctaaaactgggcagcaccgaacgcgtcacccgcctcttcgcctaccccaacaactgcagcgtgatctgctaccgcaactggaccctggaacagaccgtcgcccattacctgacccagagcgtgcagcgcgacggttatgccacagcgaaggtcctggtgaaaaccgataacgaccagctctacgctgaaatcagtggcgtgccgaagggctatgacaagccgttgtcggcgttgctcgacgcgggagatctggcctacaccggcgccagcaagctcaacgccgacggcaagtgggcgtacagctggtatctgttcctgccactgggcatggcgctggaaaatcgcaagagtgtcgagttgctgcacttcccgccagactattcactgactcaagcgcaggattatctgcgctccaacaccactgatcgctgggcaacactactcaccgacaacggtattccggctgaccagacgccggccttccagaccatcattgacatcgccccgatcgccgcgccatccagcgcgggcaaggatctggaaggtgtctacgactacttcaaggactatcagaccacgctggtcaaacagttcagccagaccgccgccggcactaccttgccgatggtggcgttcggtgcgccggtgcgaaactggatcaagcagcaatacgggccgactgtgaatgtgctgggcctggcgaccatcagtccgagcgaaggtgtgaaagtgccggtactgggttcaaaccatccgagctacatctggtacgccgctgacccggcaagctacgacggcgatgagaccaaggcggatgcagccggcctgaaggtcatgggccaggatctgagcgctgcctgctggcaggccggcatgggcagcaaaccggggagcgatgcccaaaccacgctgaccaattgcactcaaacctggcaggtgacgcagaaaatcaaaacctgcgagctgttctacacctcgatccgcaacctgactgcggaacaagctgcaagcaagtgtgcgacgccaccaatcaaggcgcagttgcagcaactgaagagcgcattgcccgccaccgccattcccgccccacacctgtaaccggtgatatgtcttcccgtgtcagcctttgctgacgcgggaatgcgctcattacgcctgtcagatctgacagtagaccgctactgtcgcatacacgaaaattcgatccacaatccgttgcaggactgacatgacgtcagccaaaggaagtcgcagcccctgacgacaaggatcgttatgaacagtcacgcactcgccagcgatgctcgcgataccgaaggcatttacccgttcgccggcctgccggttcgcctcggttttccgtcgagcagcgacttcgaaatagtcctcgataaccactgccatgcggtggccatcgccgcgcgccgggattttccgcgtaccggccgcatgtgccgggtttccgggcaattgttgccctatcgctgccgacagactcgacagctgctctcaggcatccacgtctacgacccgcgcttttgcgggctgctggaacacgcttgcgacccgaacgtatttctcgacatgagcgagctgtggttgtgggcgttgaaagatatccacaggggcgagcggctgaccatcgattacgccgccaccgaagacaaactgctgcaacagttcgcctgtgagtgcggctcgacaaagtgtcgcgggtggatcacaggttacgacgaaccacccagtatcgaaggccacgcctttctgcaacgcttgtggagccactagcgtctcgctgattacggcgcgccaaccgggcgcaaacgatattgcggcggcaattgttcgaaaccactgatggtggtgttcagacttttccagcgaccatccttgatgccgtagatgcagccgtgaatcgacaggctctgcccgcgatgccaggcgttctggatgatgctggtgtgcgcgacgttggccacttgctggatcacgttgagttcgcacatgcgatcgacctgttcttcttcggtcggcagcttggccagctcttcgcgtttttcgtagtacagatcgcggatcgagcgcagccagccgtcgatgaggccgaactggcgatcctgcatcgacgcacgcacaccaccgcaaccatagtgtccggtgacgaggatgtgtttgaccttgagtacgtcgaccgcgtactggatcaccgacaggcagttgaggtcggtgtgcagcaccacgttggcaacgttgcggtgcacgaacagatcgcccggcagcatgccgacgatttcgttggccggcacgcgggcgtcggaacagccgatccacaggtattcaggggtttgctgacgcgccagcttggcgaagaaatccgggtcttccttggtgatcgcgtcagcccaacgctcgttgttatcaatcaggtcttgtaagtcatgcatgctgtaaggcctcaagaaagatgcgctggtatgacagacgaccgcccgtcggggtcacgccgccaccgcaagtgatttcattggaattctcgtgtgcccggtgagtccacctaagtaaggcccacagtatgaggatttgccatgactgattcacgacgcccttacgatgcggtgcaaccggaacccatcgatgataacgaagaccgcatgggttcggtgcatgagctggatttcgatgaagacgagccgagcgcgaagatcggtgatgagatcccgcagcgtgagcgcgagcagttgatgcccaacgagcgcgtgcgtgaggcgggcatgaccggggcatcggtcagtgatcatgagccgacggacgatgacctgagcccggaaacgctgattcatgaagacggtgcgcgggatgccgaggaagcgggtcaaggcaatcaggcggattgggatttgagcattgtcgatgaggatgacattggcggtggcaatggcctggatgaagcggagctggcgcagcgggatccgctggatggcaaccgctaacagacgcgccttcctgtaggagctgccgaaggctgcgatcttttgatcttggtcgtaacatcaaaagcaaaagatcgcagccttcggcagctcctacaggtcattagtcaaccagggtgcaggccatgaccacggcatcttcacgcccgcccaccgccggataataatcccggcgccggccaatctcgttgaagccataacgttcatacaacttgaacgcgcccgtattgctgtcacgcacttccagaaaacattcccgcgccgaagccgcataggcccgcgacatcagatgctcaagcaacgtcaggcccagcccgcgcccctgattctccggtttgacggtgatattgagcagatgcgcctcatccagaatgatctgtaccacgccgtgaccgacctgttgctcaccttcgaacatcagccagatctgatacttgcccagcccatcaagaaagatcccgcgagtccacggatggctgtaagcggcgtactcgattttcagcacggtttccagatccgcctcggtcatcgggcggaacgatacagcatcactcattcgattctttccagcgcgccatcagccgacgcatggcttgccacacagcggccttgcgctgtggctcttccattaacaattccagactgggaatggcccaggccgaacccagaccttcgatctgcaactcacgattgaacgcttcggcgtccgcttcaccggcaaaacgcaccgccggcaggccaatcagccacaggcaggcgcacggtgcggcttcgatttgcacggaaaggaaaccctgcacaaagtcacgcgccgcttccgggccctgatccatggtgccgcgattgagccacggccagcgcaccggctcgccgacgatttgcggcgcatccggcagaccggcggcacgcagcatgtctttcagcagcaaatacgccggatcgcggctctggaacggttcgcctgtgggtaactcgaccagcagcaggcatcgtccggcgcgcaacaattgcagggcaaaacgcggtggcggcacgggtgcaggcttggcgacgactggcgtgtcgtccgcctcttccaccggtttggcgttggttcgcgtgctcgccagcgacgggcgcggcacttcgatcttcggccgttcgctcgggcgcgcaacaggctgcaccggcgcttcggcctgaggcgcgggcagcaacggcacctctacctccggctcaggcatgtccagcagctcgagccgcgacggcgcggcgaagggcaattcggtgcgcggcagccagttgaccacctgcatggcgttcaaataggcgcggcggcgggactcgataagcaaagggtcggccacttgtggataactgaagtgcgctgattctaccgcccttcgctcaagatcgcttgctgttgatcgatagcctttatcttagaaaatgcgacagcccgtcccgagagtgaatcgcatccttcatgatgcagtacaatcgcgtctttttattgccaacccgccgggcattccgatgatcgaacccaagcgcgtcttgcgcgccctcgctgaacactgggcacttctggagcctttgtgcgagcacttcgaccaaggcacattgagcctcaacgaattgcgcgcgcaactggccgcccaacaactggacagcacgccacaggacatcaccagcctgctcgacgtgtggattcgcctcgatattctgattccggtggcgaaaagcccgaaccgtttcgagctgaacgcgcagatccacgacttcctcgcttacctgcggcgtgaacaccgactgggcctgtgcctggaaatcgaagcctatctgcgtcacctcgagcgtctggccggttacatccaggacgcgttcgaggttcgcgacggtcacgacctggcccgccagttgcgcctgctcgacatgcgcgtgcgcgatgtgttgaagaagctcgacaacgacgaacaggcgctggtggccgtggccgaacgggcgaagaccagcgaccggcagattccattgcgtcagcgttacgctgaagtactggcgacgtgggacgaatacgtcgagccgatgatcgatctggttaacgccgacggcgccttcgaacaaggcgtgcgcaaggttgaaaccgtgctgttgaagatgcttagcgagcagcagcgcctcggccatctggtcgatgacgacatgctgctgcgtacccacgcgcgcatcctcgaaatgcagaccagcgcccagctgaccctgcgccacgcccgcgaattgctgctgccactgcgtgaagaagcgcgccggcacaacgccgtgacccgtggcgcggcgctcgccttggcggcgattcgccgtaaaggcatcgatgccgtgccgcaagcggcgatgccactgttcacccgcccgcaaagtactttcctcggcagcgccagtcaggtcgaagcctatgtttacgccttggcgcgtttcgagccaaaaccggcgcgtttccccaaggcgcacaaaacccagaaaggcgaagccccacgcgccccgcgcaccgtgcgcgagatggtcgaccgttgcgaagaagccctgccgatgccggatctgatgacctggctgctggaacaggaaccggacggcgccaccgacgaattgctttactggttctcgcgcctgtcgcgggaaaaacgcttcaagcgcgagcgtctggaacgccgcgaataccacactcacgagcaccaggtcagcctgcgctccttcgccctgctctcggccagcgataccgccgccgagaattccgcgagcacccccaatgcatcttgatctttccgaactgtcacaactcgcgccgatcttccgcgagctgttcaagggttaccacgtcagccgtcgcgacccggagctgtacgcgcaactgtcgaacttccaggatcaataccgcacgctgttcaaggcgttgggttttgaactggtctgcgacacccgtggtttctactacttcgtcccggacatggccgctgcggcggtgaacaagaccgcgcagcgtctggcgctgttcaccttcatcctcgtcgaacacctggccgatcagggccgcgacccgattgccgtgctcgatggcggcagcctcggccgcgaagagttgccgtcgctgctggagaaataccgcgacctgttcattcaggccgaagtgcagaccgtcgaagaactcgaagaaaagatcatgcgccgcatgactcaactcggttttgccagcgaagaaaacggcgtgtaccgcttcctgccgccgatgcaccgtttcctcgacgtgtgcctgtcggtgcaacaagaccgcgacttggcagccagcgtgcacagcgtattgccgctgccagcgccggtgctgatcgacgaagccgcggaagccaaattcctcgaaaccgacgatccgctcgatctcaccgagtttgacgaagaaagcgaagaagacgcactggcccgcgccattgccgaagaacaggagtccgacgcatgagccaggaacgctacggcatccgccgctttgctcttttgaacaccgccggttacagcctcggcctgttcccgctggaagaaccgttgtcggtttacggcgcgaacaacctcggtaaatcggcgtcgatcaacgcgctgcaattcccgattctggcgcgcatgtcggacatgagtttcggcaaatacagcctcgaacaatcgcggcgcttctacttcgcttccgacaccagctacatccttgtcgaagtgaatctgccccacggcccgcacgtgatcggcgtggtcggtcgcggtcccggcggtggtttcggtcaccagttctttgcttacgccggcaagcttgatctggcgcattaccagaagaacgacacctgcctgcgccagaaagagctgttcagcaaccttgagaaagaaggcctgaaagcctacgaactcaagcccgatgaactgcgccgtttgctggtgggcggtcacacgtcgattccgctggacttgacgctgatcccgctgcgctccaccagcgaacagagcctgaagactttccgcgcgttgttcatcaacctgctgcacatgcgcgaaattactgcggccaaattgaagcagttgttcctcgatgccttcgaacacagcctgcgttccggcagcgtcgactacatcgccgcgtgcgaagaagccttccgcgatgtgcggcgcatggagcaggactacaactcgctggtcgctgccggcccattggttgaagccttggccaatggcgtgaaacagcgcgacgtgctgcgcggcaaactgcatcgcctgtcaccgctgctcgactcgttgctcggcacctggtcggactacgccagtgcgcgcaaagaagagctgaccattcaggccgaccattaccgtggtgagcaggacagtctgcaaaacgatcaacgcggtggcacccaggaactgatgcgtctggagcgggaaatttccggcatccagcgctggctcggcgagttgtcggtgttgaagaatcgcttcgccctggtcgatgacgtcaaagtgctcgagcaacaattgctcgcggccaaagacgcgcacgatgaattggccggtgccttggcgcaatcccgccagttcagtgccgaagatctggaagagcgcgtacgcgatctggaaaaacgcctgaagtcggtgaagcagcaactcgatcacgccgacaacaacagctacgcccgtctgcgcgaagagttctcgcagcaggacgtcgagcgcttgatgcggctgttcaacagcgcgctgttcagcctgccgctgggcgaacacggcatcaccctcgacgaagatggcgcgtgggtcaaatcggttgagctgatcctcgatggcttcaaaggcgagcgcttcgaagtgccgggcctgtccatcgacatctcgaatatcgagccgccagcgctgcaagccttggctgaccgcgcggcattgcgcgatcagaaagagcgtctggaaaaagagctcaagcaactgaaaacccaacaggctgtagccgccgaccgcgccgcgagcaagacccagaccgaagcgctgtaccagcaagtgctggacgcgcagaaagccctggaagatttccgccgcacgcagaccctgagcgccgaagaaagcgacaagctcgagcaactggctcagatggaaggcgcgcaggacgaactcaagcgttccagcgatgccttcaccgaacgcgtccagcaactgtcggccaagctgcaactggtcggccgccagatcgccgacatggaagccaagcaacgtaccctcgacgatgcgctgcgccgtcgtcagctgctgccagcggatctgccattcggtacgccgttcatggatccggtcgacgactcgatggacaacctgctgccgctgctcaacgactatcaggacagctggcaaggtttgctgcgcgccgacggtcagatcgaagcgctgtacgcgcaggtgcgtctgaaaggcgtggccaagttcgacagcgaagacgacatggagcgccgtctgtccctgctgatcaacgcttacgcgcaccgcaccgatgaagcgctgacgctgggcaaggcccgtcgtgcagcggttaccgacatcgcccggaccctgcgcaacattcgcagcgactacgacagcctcgagcaccagctggcgctgttcaaccgcgagatcaacaagcgtcaggtctccaacctgcagagcttccgcatcgtcctcgcgccgaacaaggaagccctcaagcacatcgaccagatcatccacagcgccggtcagtacgaagaaggcgaaaccctgtcggtgttcgacctgagccaaagcgccgagcaggacaacaagaacgaagaagccaaggaatatctggcacggttggtggcggcaaaccacaaccagctcggcctcaaggatttgttcgaactggcgttcgagatcaccaaggtcaacggccagccggtgatccacaccgacatcgatggcgcagcatccaacggcacaaccatgaccatcaaggcgctgaccaacatgtacttgttgctgcacttgatggatcgcgatcaggccggccgcgtgcgtttgccgtactacctcgacgaggcggcggacatcgacgagaagaaccaggccgcgctgcttgaaaccagcctgcaactgggcttcgtgccgattctggcgagcgtgaagccgcaggtctgcgccagtgtcgcgatcgacctggaaggcggcagcggcccggcggggatctacattgatgaggcggactggaagtacattcgtcgccacgatgtggtgaaagcgacgttgaatgttgaggcagatgaaccggagctggatgcggtttgatcggcgttaactgaaaggcaaaaaaagggccgcgatctgatgggatcgcggccttttttatgcttgggatttgtgttgattttgcgggcgttatcgcgagcaggctcactcctacagttggaatgcgttcccctgtaggagtgagccggctcgcgatggcgccacttcagacaccacagaattacttaccgagcgaaatcttcggcgcccacgtcagccactcatcctcaaacttgtcgaacaacgggaaagtctgctccgcccgtgcggggttacccatgcgctcgccatccggcgtggcgaaagcaataccgccctgaatcgccgtctccagcgactcggttcgcaccgtcaagccgttgaacaaaccaatatcaaagcctacgccactggtgttccagaagcggctgccgctgcgcaccaacggcgcgtatttcggctcgatcagaatgtgcaccaacacacgatcagcggtctggcccagctcatagcccgtcaccttacccacggtgatttcgcggtaagtgaccggcacacccggcttcagcgaaccccgacgggccgcactcaacaccagactcagccccgcctcttgtttggtcacttccggcgcagcggccagcgcagtgaagttattctgcgggccgaggttcttggttgccggctgcacttcgatgtacttgcccgtcaccagggtttccagattctctgtcttgatcagccctaactccggtttgaccacccagaactgactgccaacccgggcaatcttctccggcacctcagtgatgcgcgcggtgaggatgaccgattgcaggtcgtcagtcagatcgacgctttcaatcttgccgacgtccagtcccttgaaacgaaccggcgtgccactgctgagaccatcagcgcgatcgactttgatcgtcactacgctgccttttttactggcgtcgtcatgattggcgaacagacggaaacgcgggatgcgtttctgcaacggcgccttggcttgcggcgtttcgaaggcgatgccgccagccattaaggtttgcagcgactcactcttgacctgaatcccgccggtcaaaccgccggtcagggtgactccgctgacgttccagaaacgcgtcgaagcgttgaccagactttcgtattccttctcgatgtgcacaccgacgatgatctgcttgcgcgtcttggagaactgatagctctgcaccgaaccgaccttgacctgtttgaacagaatcggactgccgacatcgatggagccgagggtgtcagtgaacaacaccaggtgcagccccggtgaacgcagatccagcggcggcgctttcggccgcgcctcgaattcgcgtttcggtgccgcgcccttgtcacccgggcgcacggcaatatagttacctttcaccagcgcttccagaccggtgatcccggcaagggaaatcgacggtttgaccacccagaactgcgtgccgtcaaccagatagtcttcagccagtggatcgagggtcagctcggctgtagcgctgttcagatccggatcgaccttcagcgctttgaggttgccgacctgaatgcctttgtacatcaccggcgtacggccagcctgcaggccttcgaagtcgctgagtttgaccttcacacgaatcccggcagcggcggcgtcgaagtcctcatagagtcggaacggcaggcttggatcggtcggcggactgtccttgcgattttccggcgtggcgaaagcgataccgccggcgacgatgctggccagtgactcactgcgtacttttacgccggacaggttggcatcgatgctgatgccgctggcgttccagaaacgcgtgtgtttacgcaccagtttggcgtaggtcggctcgatgaagactttgagttcgacagtgctctggtcttcggaaagcagatagcttttgacctggccgactttgatctgtttgtagaacaccggactgccacggttcaacgagccgagacgatcagccttgatggtcaggtgcagaccgggcttggcatcggacagcggcggttcttcggccaacgctttgaacttgcggatcggctcgccttcgccggggctgatggcgacgtagttgcccgacaccaaggtctccagcccagtgataccggccaaggtcacgctcggcttgaccagccagaagcgcgtgctggtcttgaggtattgctcaacgtccttgttcatctcgacggtggcgatcacaccttttgagttgccttcatcgtcgagcttgagcgtcttgaccttaccgaccggcatgcctttgtacatgacctcggtcttgttggcctggatgccttcgccgctttcaaagcggatctgaatctcgataccggtttcggaataggcacgccaaccgagccagccaccgatgatcagcgcgatcagaggtaggacccaaatggcggaccagttcgaggccggtcgggttttcgctacgggcaaatcagtcatggtcgtcgtccgactccgtgttatcccaaatcagtcggggatcgaaagttactgcggcgagcatcgtcagaatcaccacactggcgaaggcgatggcgccaagattggcttcgacactggcaagccggccgaagttgacgaccgccacgagaatggcgatcacaaatatatcgagcatcgaccaacggccaatgaactcgataaaacgatacatccagatgcgctgacgagcggataacggctggcgtcgttgcaccgaaaacaacagcagcgcaatacccaccagtttgaaggtgggcacgagaatactagcgataaacaccacggcagcaatcgggatcatgccgtgctgcaccaactggatcacgccggacatgatggtgctcggatcaccctgccccagagaactgacagtcatgatcggcaagacattggccggaatatagataatcgcggccgtaatcagcagcgcccaggtgcgtactaggctgttcggacggcgagcgtgaaccagcgcaccgcagcgggtgcaggtttgctcctcggtgtccgcttcctgcctgttcaactcgtggcattcggtacagaccagaatgctcgcatcaatcgcccgcatgagcgtcctctcctgataacgcctgccagatctgatgcggtgacatcaccacttccagccagacctgcaccaataacaaaccgatgaaacacgctaaccccaagcctgcggtgatggccgccatgtcagccagtttgacgatcgccaccaaaacgcccatgaggtaaacctcgagcattccccagtctttgaggtggtggtagatacggtaaagcagcaaaccgtagctgcgcccgacgttgaagcgaatcgtcagcaaaacgaacaactggcacagcaacttgagcagcggaatggccatgctgcacaggaatacgacaatcgaaacgccttgcatgtcggtgttgaacagaccgagtacgccgctccacaccgtatcctcagacgattgcccgaggatattgagttgcatgatgggtaaaaagtttgccgggatgtacaacagcaatgctgcgatcaccaaggcaaggctgcgctgcaccacgttatggcgatgggcgtacaactcataaccgcagcgtgggcagagggctttctcgccgtgggcaagtttcggcttgcgcatcagcaggtcgcactcgtgacaggccaccaggtcttccagcggtaaatctgacagccctggggcgtcaaccgactctgacataaaggctctggctccgaataaggtggggctattctagtgttctgattcgaaaataactgtgcaaatttgttcgccgtcgcaagcaaaactttttcgcgggcaaaacaaaaccccaactgctttcgcaattggggtttcggaatttaatcttgacgaaagccgaagaacaccataccgtctacgaagaccgcaaagtcgaagcccgcgccaatgatcacctcaccgtgggcgtgaaccagcacataaagattggcaccggccagttcattgatgctggccaggaaatccacctcagcagcggcatgaaagtggtgatggaagccggtgcggagctgaccctgatcggtggtggcagctttatcaagattgatgctggtggcgtgacgatgagtgggccggtgatcaacatgaactcggggggtggtccggggagcggcacgggggcggcgccgttgttgccggggttgttgaagcaggcggatacggataaagccgggcaggtcgtgaaaccctccctcggctccttcaaggttcagtcaaaagctggcgtgttgctaccgaccccgtcatgtcatctggatgcgacaggttgctgccctattcaccaaccgggtgcgtcagcatgattgtctccatcacgtcacccttcgaacagtctgccgcatccggtgttatgtgcctgattctggatcgcagttttgatacggatctattgaaccacctgtttcaagatgaagcatatttccggcccgaatgcattccactgtttactaacacaccatatgccgacctgcagcccgcaggcccctatgtggtcgtgtacccggaaaaacaatcagcagcgacctatgccagtaagttactgaaacagttcgacgctggatgtgtcgcttggttagaaagtccctccttgctggatcaggctattgaacactggcgcagcctactgacagtgagaaccgatgaagccccgctgcaaatgatgcgtttttttgatccgcgctggatggagccattgctgctttcgctcagtgaacccgaaaaatcccagtttctcgggccattcagcggtctcgcatggagaaacgagatcggctggcggtattacgccaagtcgccccaaagccagaagaatgtggctcagcctcccgcttggttgtacctgagcccggagcgtcaggcgttgatcgagcagaaccggttgaaggtcatagcgacccgctttgctaccgactaccacgaagttttacccgcagaaggcagcgtcgagcttgtttaccgccagttactggccggaaaagaccagggctatgaccaaatggctgatcaagagcgatggcttcgtttagccatccaacgcggggacagcttctgggacaccccccccgctgccgaattgctggcacgtgaagacatcgcactgggcgacaagctgactcaactggaaagtctgtaaatcacaaggacgacgagcaatgagcaacacctacaccgttaagagcggcgacactcttggcagcattgccgccgccaacaaatgctctgtggctgatctacgggccctgaatccgatcatcaccgaccccaaccacatcaagaccggttcggcgttgaagttgcctgcggccaagagcctgccaccgcccaagcacgccgataaccagagcacaacggccgtcaaaggtgcagtcgagtgcaaggacgaactggtcgatatcatccatatcacgggtgaaaagcacttctacatactgacggaaaaagagtcgaatgcgctcaaacagcaaagcgacatcgtcaaaaggcttatggacgaattgcaccagaatctggccaaggcgaccgaagcaagccaatgcgcaaagatcaaagaccccaaggccggctgctcctgtacgcgctgcgtgaaagatgtatggaacgccaaggctgaagaagccggcctgctgcagcgctcccctcccgtggtggcaaaaccgaaaaccgtcatcgagcgcaaggaagatctgcagggccaactggcaaccgtgcaaaaggcccgcgattggtataaccgttacacgccccagccggcttttgaaggcaactatctggaaaccaactgggaaggcttgcgagacaaaaaagtcgccgaactgaatgcggaaattcaatctctgcgtacccggatagctgcgcaaggcaaggccgaagccggcgacagttccaccagtgccaacagtgccgcaccggacgtcaagcatggcaagggacaggagaagggcaagcaggtaaagatcggcattaccacagtcgaatacatttccttccgcgatccgacccgacgtcactacatttcgtcactctctcgagagcagttcgcctggagcgtcaaggttcctactgaagtgatgcaaggcaagccgttcgataaaaatcttgccaaaacgctgatcaaggatatccggacggctgtttccgatggccgcaaaaccagcccgctcggaagtctggaagctaaactcacctcatggacaagcaaagaagacaacctgctcaatgcgctgcacaaagagtgttcttggacgtccaacgaggcggactcggccatatatgcagtctccgctgaagctcacgccttccgttttgcagcaacagccagcgccgggatcaacagttgggagcctgggaagggcaatattgaggtcggcgtcaaaggcagcgcagcgatctcattggcggaaggctccgtagcgatgaagggctactttcccgaccagggtggatacgtggttcaaatgccgtaccgtaatgccgaaggcaaggaagtcgtcagcaatatcggcatcttccgtctcgaaggcaaagtggagttgtcatgcttcgttggcgccaccgcgcaaggtcaggcaggcgtcaaagcacagtacaaaccgaaagaggctgaagcgtctggtgccaccgcgttgctcagcacgcctgacattgctgtcgacaaaaaacgcggtggcagccttggccttaaaggtaatgccttcgccggcgtgcaaggcggcggcactgttaccggcacgttgaagtggcttgactcaactaaacaaggggtcggaaaaatcgtcgcaggacaggcaaacgacagcggcagtacggattggtcgagcttggtggaggtcaaggcggaaggaaatgcggcgctgggtattggcgccggtttcgactttggcatcgagatcagtgccaaccgtttggcaataaactgcaaagccagcttggttttcgggcctggtgcaggtggtggttttggtacaacggttgatatcgagaagatcggtgatttgatctatgtgttctgcaatgccctatcgaaagccgactttcattaccagctagcaataactgaagatgcattcaattacatgacagccgggatatttaagatcgcaactaactcaggtcaatctgttgcgagcgtctttgacggcggcttcagaaagatgtcactctggtggaaacaaagagaatctaccaaacaggaagcgcaaagcctagcaaaatatttaataaaaaaccaatcgatacaaattgataaaaaaacaataccactccaaatgcttccccctcaagccattggacccatgctatacctattaactgaaggttttgtggaaagctgggccgaagatcaagaacaagcgatagttttattactatctcacttgcgcagctggagacatttcatagaagcactagagcactgctcgaaaaaaggtagtaaagttaacgccctgactagcttgaatcgcctcaactctatacttgacggagccgaacaacagcaatttaaccgtttcatcaaaacactagcagtaaacaccagcagctcaacgattgactacggaactcttgcatggaatccaagcctgccttggcgcaaagaaagaactttacttgcggcaagacgcagcatcaactttgagggtctagcctaaaaaggcacctaaagtagtgcctttccacattgaaaacctcagagagacttgtccgactgaatcgcacatcggaaacttgtacctggatagtaagcatcctcgtttggattttccggccagcgccgtactaccggcgctgctgacaatggggcttcggggtaatttgacccacgttttactttctgtttaccattttttggaccgccaggattttctaccggcgaattctgatagtaatcatcctcgtaccagtcatttacccaatcggttgcattgcctgataggttatatatgcccaacggattaggaagaaatctatcaacaaagaatgcttccccctccccttccattggaaaatttttaccgaaatccaagctcccactgctagttggaaacaatatatgctgcccgcgatttctcgccgcaaattcccactgtgcctccgttggaagatctacagcatagccgctgatgcccgctatccagtgacaataatccttagcttcctgccaggtttttgtaggcgcaggaagcctgggagagtacatactctttaaatcttctctattacgaagcttagcatcaaacacctctttaccttgcgacacaaagaaaacatcaaaatcatgcacggtcgtctgaaatcttgaaagatagtaagagcttaacttaaccggatgtacaaaatcgtcatctgtattgcggctaatattacaaagctggtccgttttttgcccacagggccaggtgcaaacatttttttcgtcgtactcacaagcccaaccaaaatcccccatatcaaactggccgccctcaacaaaaaccatattgtcgattgactgcacaaccgtattcagcactttgtcacgtagttcgctcgaaagatccgggtattttgtcttgatggtcaccgcaatcgacgcgactttctccggagtcaggctttcgctgttcggcaacgggccggactcggcttcacaacctaccagcagcatgatgaaaggaagggcaagtaaagactgacgaaacacgagcaatatccttataagatgcgtcaaagagtaaccttaccatcccatgccaagactacaaaaccctcgaccattcaccgcagcgacttccaactggccgaaggcaaaagcggtcagccgttgctggtcagcggccatttcctcgctctcaccgcgcacccgaaagccaaatggaacgacctctggttactgaccgaagtccaccacgaaggcaaacagccgcaagtgctggaagagtcggtgaccagcgacaccaccgcactcaaagacgatttccaccaaggctaccgcaaccgcttccaggccaccccgtgggacgtgcccaaccgcccgcccctgcgccacccgaaaccgcgcatcctcggcagccagagcgccgtggtcaccggcccgaaaggcgaagagatccattgcgacgattacggccgcgtcaaagtgcaattccactgggaccgcgaaggccaggccgatgacaaaaccagctgctggctgcgcgtctccagcgcctgggccggcgcccagtacggcggcatcgccatcccgcgtatcggcatggaagtgctcgtcaccttccttgaaggcgaccccgatcaaccgctgatcagcggctgcctgtaccacaataccggtacgatgaaaaaggtcgcagagcctgctagggatgtgacctcgctcacagtggttaatagctatcaaatcagcgtaggcgcgcataccttggggcaaggtcatcacatgcccggccacccctctcgggccagctcagcaagactttgaacattttttcgccctacgcgaaatggtgagaaggatcgatgcaacgcggaaatttttaaacacctcaccgcccttgtgtaaaatttcgctcctttgggtcagtgcgcttttgacaatgctgaataaggacgaaccccatggattttgatcacgacctacctcggcttggcgacatcctgctactaaggggaaagagcctgttgaccaagcccaatatggccattcaatcaatcacacgcttgcaaatcgcgagctactcacatgttgcgatggttaccggtcagaacatgataattgatgccaatccaggcatcggaatcaccttgcgtcaatgggataaagtgagtcactcctacgacatcgccaattcgttgttagtccgacaccgctacgcagacgatgcggcgacttggaatttgctcgaacaggctcaatactattacggtcagaaatacaagataactgcgttaatcagtaacgaggcggaattttctgacaatgagggcattgtgtgctcacagttcatcgcgcaaatttttcaggattgcgcactgccctgctcaggaaagtcgtgccgcaaaagccttcccacagatatttatacttttaccaaagccagctcggaatgggttcaacgtccgctctcggaaatcagaattggaataagttgccgctctagcgagatcgctcactccattgttcaagtcaatcaccaaatggataattatgtcgctgcatcgctaaagcaggcgtttgatttaagtcgtcagtttcatgagttaacggcagacatagcggacgcaacagacttgattaacgtagcgaatggtggcttgattcctctggccaagcggatggaagcagcagccaccagcaacatttccatcgagcatttcagtaaatcgtggcggcaatactttctcgagccaagagccaaggcaaccttcctgcacgaggccggtacggcagctgagcagcctataaaaatcttcattaagacatgtgaaattgtaaagcaacacaatacagcggcagacaacgcgtcggagcaactgaatttgttactgacgcagcttgaacatatttcaaagtcccttcccgcgacgccctctgacattgaaattcaaacgtgggttatcaaccatcttgagatccgcaaagaattacagcggcaaatagatattcttgactggatcattatttccagtccaggcaatcttgattttgccaaaagctttgatttccaagcctttatggaagaatacgataaagaccccaagcctgatttcaatgaagcaatagatacgctggtgatcattgctgactattgtcgccattgtaatagctgggcacaacaacgcccgctttatgagcagataatgagtgctcatcacctgctcggcaatgtacaaggggccgcgctccacgccccttgaacatgcctcgccccccgcattgaggccggaaaaggccggaacgacctgctcatgcaaatccctgcacaggcgctggcgctagcacacactgtgtcctaacctttcctggccaacaggaaccacatgagcacccatcggcaatgtggactaagggagcaagcgcatggcgaacaaaaaaggaactgaattggtagctgatctggggacaatcgacgaagcagcaggaattttcggaatatgttattcgatactgacatggagtggtgtcggaaaaggattcagccctttcagcttgggttcctggacgaaaacgctaggaaaacttgcggaggatggacacgcaacaacgtttcttatcgatggcgaaaacatcacactgacgggaatcagtgagaccggttgggaattctccacgggtacgcttgcctcgcaggattgggcgcgcgccaccggaagcgcaacgacgtacgtttactatattggcgtaaacaagcagttcataaaaaaatatagaaaacttcaagccaagttaaagaaaacaaagaccgcctatgacgtcctttggccaaatcttgccaatgcgacaacccaataccagaactgtgtcagccatagccactatctggtttccgagctaggcctcgctcactgggcaaacaccatcaagggctggtggatgccgtccgcaagcaactgggtagattggtttaaaagtttcgcacctacccaacgagacgggttcagttggaagtacaagaaattcgatagcacaaacacgcacattccataaccatctttccgggacggcaatgaatacacttgcgcgcacctcgcccgccatttcatctacgaccgagccccggccattcggggcttagtcgtagatagaatgtacacgcccccctcacacatctgaacaaggagaggttcatgaccaggattttcgtactgttcacgctcatcaatctgctcgccggttgtaacagttactctgacggacacccgcgcagttccgaagaccccggctgcaaaactgcgcaaaaacaggcaggttgcctctaagcgattgcgccaaggcacgggtttcaatttgcccattgacgggcgatcgcgtgcgctcgctctttacccgtgcggaggtaaaggcgatggattagcgatcagcgcggtgaacagtctgataggggccgcagtgtctactcgacggacatgtacggcacaaaaattcttgccaatgggaagtgccagtacaaacgtcccgtcccagacgtgtaaacgcaaagccttgcctgctgcgaatattctgcggttgacgctatttagctgcggtaaacactcaagctagcagggttttaattctttgccacttctctatcaaacgatgattctttgcctggatcggagttgcgcctcaacgaagcggtgacgaaatgcgcagcgcatctgagaggtgtggcaatcaacttcagacagaagtcgcgccgcgcagtaatctatcggtttagcgcaagtctttagccaaatcgatcgatggaggatgatccttgtatgacgaaacaaccgcccgtcactcaaccagccgccagcgccgccgatatcgagcgttcgatccaggccctgaacaaaatggctgaacgcctctggggggagggtcgagaggcggaagccaaagccctgctcgatgctctcgacgccttgaaccgggcgctcgaccgaattcgcattggtgagagccgcagggccgctaccctgcattgaacctggcgcttacggcttgagaatcagcaatggctcagccttcttgacgatgtaggtcgccagttccgaccccttgtcctggccgacgttcctggcgatatgcgccacgccctcaggaatgaacagcgaatctcccgtcttcagtgtcactggcgccctgccttccaattgatattcaaaagtgccgctgatcacgtacgccacctcgacaccggggtgcgcatgtttcggtgaagtcactcccggggcgaaatcgactcgcgcctgaatcacttcgcgatcattcgcaccgagatcctcgcgaaccagatcggtacggctcaaaccttgctgccagctcttcggttgggtgtccgccgcgtgagcgataccgatcattgaaatgactaccgcagcagtggccagaaacaggggacggcgcatggtgttgccctcttgaacgtagtggtgtggagggctttattctgagtgcagcatgttggcggaatgtgtcgcaagccggacgtttgttatgcgcatgtgtacacgaacgggctggatacacgcttatacaaaagagtcttggtcttgccgcagcgccaacagccaggttcggaaagcgacgatctttttcgagtcggcggttttatgcggtgagataaatcccaagggctatgtcgccgcactggagctggataatgctcaagtgctgacggaaggcccggcgatcctgcagtaccttgtcgacctcgtaccgggcaatcgactggcgcccgcacccggaacctgggcgcgcacgcgcttgcaggaacagctgaatttcatcagcacggaaatccatggcgctagcgcgccgctgttcagcgcggatattcccgaagcgatcaaggccatcttcaagcacaagctgttcaagcgcttggactatctgaaccgcactctcgccgaccaggactggctgatcggcgacttcagcgtcgccgatgcctatttgtttaccgtgcgcagatggctaccgaccttcaacatcgacatcgtcgactggccagcgctcgacgcttatatgcaccgtatcggttcgcgcccctgcgtggcggcggcgatcgcggctgaagcggcaacgcaagcagtttgatcagggcgcagcagccggcagatgttgttgcgtcagagcgccaggactttccccggtatccggtgcaaacgcggcgatatacaccaacccgacgacatttggctgattgccggcctcggtaatcactgcgccgccccagaatccgtgtaccagcacaatcgtcggcttgttgctcatggccctgctcctgtatgaaaagagaagatggttgcctgtttcgcgcagaagtatggtgccgatcgcccgaacgggccatgtcggcaacgaatctgtaaactgacgcgatcttcactcgctcaaacaagagaaccccatggccaatcaagacatcatcttcacccccgatccggatgccgattccatttcctccgacgtcactacgttcaacggcatcatagtctccacgcagatcccgacccgggccgacggcagcctggaactgggtggcatcaccgagcagagcgaatgcacgctgcaggcgctgaaagtcgcactggagcgcgccggcagctcgatggatcgggtcatgcacctgaccatctacctcaccgacatggccgaccgcggcgcgttcaacgaagtctaccaacgcttcttcgccaaaccgtggccggtgcgtgcggcagtgggcgtggcgtcgctggccgttgaagggatgcgcgtggaagtcacggcgatggcggccaaggcctgatccccgacaactcgtgttggcgtccgacaggcgcgcattgatactgaatgtgccgacgccttcgcgagcaagcccgcccatacagggttgtgtaccacagtgtgtacgaacctgttggcgatacatcgacttgcaaccaaagcctttttcgacacagcccggatacgtccctgcgctcaaatgcactcaaggtttcaagggttcacaaagacccctcggccaaaggttcgcacaggagacgtcagcatgaaaaaggcactgcacacccgcaacaccgcgttcggtttgtcgattctggctttgtcgttgttcggcgcagtgaccagcgttcaggcgcaagcggtggaacctgcgaccgtcagctattcggcgccctcgcccttcggcccgttgaaacatgtgaaggccggcgtgctcgacgtcgcctacgccgaaaccggccccgtcgacggcccggtggtgatcctgctgcacggctggccctacgacattcacagctacgacgaggtcgcgccgttgctcgcggccaagggttatcgggtgttgatgccgtatgcgcgcggttacggcgatacgcagtttctctccaaagacaccctgcgcaacggccaaccggcggcgctggccagtgatgtgatcgacttcatggatgcgctgaagatcaagcaagcggtgctcggcggttatgactggggcgcgcgttcggcggacatcgtctcggcgctgtggccggaacgggtaaaggcattggtctcggtcagcggttacctgatcggcaatcaggccgccgggcagaacccgctgccgcccaaggctgagttgcagtggtggtatcagttctactttgcgactgaccgtggccgcgccggttacgagaagaacacccacgacttcgccaaactgatctggcaaaccgcctcgccgcaatggaagttcgacgacgccacgttcgaccgtagcgccaaggcgttgcagaaccccgatcacgtcgacatcaccgtgttcaattaccgctggcgtctgggcctggtacagggcgaagcgaagtacgcagcgctggagcagaagctcgccacggcaccgtcgatcagcgtgccgaccatcacccttgaaggcgacgccaacggtgcaccgcacccggcgccggaggattacgccaagcgctttaccggcaagtaccagttccgcttgatcaacggcggcatcggccacaacctgccgcaggaagatccgcaggcgtttgccaaggctgtgattgatgcggatcacctgtagaaactaaaaagcagtcagccgcgaaggctgactgcttgattatttgatagtgggcttgaggcttgagggatggtcccgttttacagatgcttgcctgaacggacgccatcgcgagcaggctcactcctacagggggaacgcatttcaaatgtaggagtgagcctgctcgcgatcacgcccgaccagacaccatcaaccccgactaacgtacgcgatcaattggttggcacaaccagatccaacgccttgttcaccgccaagtcccccaacatgaccacttgcgcaatgccaagcagcgtctggcgtacgcgtgggcaacggcgcaaggtgttgtagccgttatgacgtaacagtgcgtgtaagttaaaaaccccctcaccctagccctctcccaaagggagagggctagggtgaggggggaggtacgccgacgtggaatttcgaggtgaattcaggtgggtaacggcttgggttatttgaccaggcgtttttcttttgatgggcgatagccgaaatacgagctgtagcacttgctgaaatgactcggcgaaacaaacccgcaagccaccagcacctccacctgcgacaactcagtgtgctgcaacaaacgccgcgcttcggtaattcgcaattccaggtaataacgctgcggtgtggtgcccagttgttccttgaacagacgctctaactgccgacgagaacgcccggcgtacaccgccagttgctccagctccagcggttcctcaagattggcatccatcagtttcaccacctctcgcaacggcgcactgacgcagaggttttcatccggtttgatccgccggtagcgcgattcttcgaaggccagaatatcctcgatgccttcgaccaaagctttgccgtgcaggctcttgatccagtccagcgccatgtgaaacgccccggacggacttgatgccgtcaggcggtcgcgatcgattacgtagggttcactgctgacgtgggtggctttggcgatttcggtcagcgccggacggtgctccgggtggattgcgcagcggtagccatcgagcagcccggcgcggccgagaaaccacgagccattccataacccggcaagcgagatgccgcgctccgctgctgatctgagcaagccgataaactcatcacttgcgcgcagttcggtgcgatacccgccacacaccaccagcaggtccagttgcgccagcgcggctgaatccagacgtgcatcggggcggatcaccaggcccaggtcactgatgacttcgccggcgcccaaaccaaacgtacgcgacgaaaacagccccgggcgcagcaggttggtggtgacaaccgtgtccagcgcctgggtaaaggccggcagtgaaaaatgttcgagcagcagaaaaccggtgcgggtcaggcgcgtgtcatccgcgccttgctcattcagatagcggaggtttttccccttcatgcctccgctgaattggcgtcgttcgatcaagttatggtccatcggtcatgttgttatgcgccgatagttggcttgatcggtcaaagagtcaatcacgcctgtggttgatggctggtcacgcagtgaattccgcccccgccagcggcgatggcatcgatgttgagctggacgatttcgcgatccggatacagttgcgaaagcagatcgaaagcctttttgtctgccgctttatcgccgaactccggggcgatgatcgcgccgttgatgacgaagtaattgatgtaaccggcggcaaagtccgggttgttctggttgaacttgcttttgcgcggtttcagcggcggcgacatcgtgtggatctgcaatttgcggccatcagcatcggtggcgttcttgaggatttccaggtgcgccagggtgaccttgtgatcgtaggattcagggtcggtgtcgaggttggcgatgaccacgccgggcttgatgaagcgcgcgtagaaatcgacgtgggcgtcagtgatgtccttgcccttgatgcccggcagccagatgattttgcgcaggcccaggcgttccttcagttcggcttcgacatcggccttgctccaatcggagttgcggttgctgttgatccagctgctctcggtcatgatcccggtgccgtgaccgtcgacctcgatgccaccgccctcacccaccagatcggtgcgtatgtacgtggcttgcgcgtcgtcggcgaccagtgcggcgatcttcgagtctttaccgtgctgctgtttgccgccccaaccgttgaagttgaagtccaccgcgcccaaatcacccttatcgtcgatgacgaaattggcgcctatgtcgcgcatccagatgtcatccagcccggcagtgacgtaagtgatattgcgcgtaccgcaaaattcttcggcgaggctgcgctcgttcttgcggcagaacacggtgaccggttcaaaccgggcgatggcgcgagcaatgcggccgagagcttgctggacgtcttcggtgaagtcttcccagatcgcgtcctgcgcgccgaaagcgatataggcgcgctcatgtttgtcgccttcgtcgggcatgaaccagcggccttgcgcggcagccaggactttgcccggcgaaaggcccaggcctgtaaccgcagcgctgacagcggcgaccaccgaggcctgtttgatgaaatcgcgacgagtcgtcatgttgcttttcctgtagaaaaaagggccggcgcaatacgccggccatggatcatttgccagtggcagtcttgaatttggtccaggtgcgcatgcgcgctcgcatgtcggcctggggaatgtccttgcccggaatcaatcgagcataggtcgcctcgtctaggtagatatccgggttgtcgcgcatgctggcatcgacgttcgcccgcgccttggcgttggaggttgggtagccggtgaaattgctgatcgccgccatgttcgccgggcgcatgacgaagttgatgaatgcataggcgtattccgggtgtttggcgtcgaccggaatcgccatggtgtccatccacaccgtggtgccttcgcgaggcacgcgatactgaaacctggtgtgcttaccggcactgtccgaggtgcgctgggcctgagtcatgtcgccgctgtagccgagtgacagacacaggttgccgttgaccagatcggtcaccggttgcgactggaacttgcggatgtacggccgcaacttcatcagcaattcactggcggcggccagatcctcggctttgccgctgcgcggatcgcgaccgaggtaattgagcaccaccgccaatgcctcgtccggcgagtcgatcatcgagatgccgcaatcggcaaacttcgccgccagctccggtttgaacagcatgtcgaggctgttgaccggtgcatcggccatgcgttttttgatctgctcttcgttgaaggtcaggccaatggtgccccaggtgtaaggcaccgtggctttgctggagtgctcgtaatggccgcgcagtttctgcaagccgggttcgatgtcggccagttcggtcagcttcgattgatccagcgacatcaggctgccggcgcgcatcaagcgttcggcgacggtgtcaccggggaagatcaggtcataaccgctgccaccggagagcattttcgcttcgagggtttcgctgccgtccatgacgtcgtagatcaccttgatcccggtttcggcggtgaagcgactcaaggtgtcttcggcaaagtagtcggcccagttgtacagccgcagggttttgtcttcggcgtgcagcgacggcatcaagcagatcagcgccaagccgatcgcgccgcgcaagcgtttgtgatggatagccatgtcaaaccccttgggtgttccagcgtgcgtgaaggtggcgaccgtcctgactcagcagcggcccgtacatgtccggacgccgatcgcgatagatgccccagctcaaacgctcttcgcgcatggccgccagatcgaggcgctgcaccagcacaccggtgctgtcgcggtcagcgctggcgagcaactggcctttgtggtcgctgatgaacgacgagccgtaaaagctcatttgcaggctcggatcggtggtcgcggtttctcgaccgacccgattcgacgccaccaccggcagcagattggcagcggcatggccgcgcatggtcatctgccagtggtcgcgggaatccaacgccgcgcagcccggctccgagccgatagcggtcggatacagcagcacttcggcgcccatcaaggccaggcaacgggcagtttccgggaaccactgatcccagcagatgccgacgccgaggcggccgaacgcggtgtcccagactttgaaaccggtatcgccggggctgaaatattccttctcttgataaccgatggcgttggggatgtgcgtcttgcggtacacgcccaacaggcgcccgtcggcgtcggccacgctcagcgaattgaagtaggcgttgccggccttttcgaaccagctcagtggcaacaccacgcccagttcacgggccagtgcggcgaagcgcgcaagcacgcggctgtcgcggtattcctcggccaacgccatgtgtttatggctttgctcgatgcagaaatacggcgtggcgaacagctcctgcaacaggatcacttgcgcgccctgctgcgccgcttcgcgcacgagctgctcggcgcgatcaaggttgccggataaatcccaggtgcacggcatctgggtgctggcgatcgtcagaatgctcatgctttcaacctcgcagcggccaggctggctgctgctgggtgatgcaatgcaccccgccgccgccatgggccagatgattgatgcgtaccggcaccacttcgcggccggggaaggcttgctccaagactttggcggcgacgttatccgcctcgatgccgtaggccggcatgatgattgcgccgttggcgatatagaaattggtgtacgaggcgcagaacacttcggcttcggtgtcgacggcgtcggtggcttcgaacagttcgatcaattcgaatttgcggccgttggcgtcggtggccaattccagcgcgcgacggttctctcgggccacttcggcgtacaccgacgattgatcgtgggtggcgtccaccagcaatacgccgggacgggcgaaggcacaaacaccgtcgacgtggccgtcagtcatgtcgccggtgacgtaatccggatcgcccggcagccagatggttttcttcacgccgagcaaacggctgaagatttcttccatctcgcctttgccgatgccggggttgcgattggggttgagcagcaccgattcggtggtgatcagcgtgccttcgccatcaacgtgaatcgccccgccttcgttgctcagcggcgtgccgaagcattccagaccgaggtggttgagcgcacggcgcgccaggctttcatccagatcatgcgccgacttgccgccccaggcgttgaagcgccagctcacaccggccaatccttgctgcggatggcagacaaaggtcgggccggaatcgcggctccaactgtcattgacctccagggcaatcagctcgatgttcggtccgcaaagggctttggcgctggcgatggccgatgggtcgaccaccagtttcaccggttcgaaacgggcgatggcattggccacgcgagcgaaatcttcctgcacctgcgccaaggtcacgcgccaacccgactcccacaaggttttgttgtgcggccagaccatccatgtcgcggcatgggtcatccactccgccggcatcatccaggcgctgtttttattgtcgttgtgctgcatgataagcctcgtaagttaagccattgtgttcaaggcgcttatgctacgagccatgaaaacggcaaacaaacgatggattttgcggataactgattagaggagcttatcgatatgcttaaacactggccgccgctcagctcgctgcgcggcttcgaagccgccgctcgactgggcagttttcacaaggcagcgcaagagttgaaccttacgcaatcggcgatcagccagcagatccgcagcctggaagcgtacctggaacagccgttgtttttccgcagcggacgcagcgttgcattgaccgatgccggccacgatttgctcagcaccacgcaagcgatgcttcagcaattggcggtggggattcggcgtctgggccagtatcagaagcccaatcaactggtgctcaacaccacgccggcgtttgcccggcactggttgctgccacgattggcggactttcgtgcgcaacatccggaagttgatctgtggatctacagcaccgatgaggtgccggacatggccacgcaaaccatcgacatcgccgtgcgtgacgacatcagcgcccaagccgaatgcagcttcaaagtgctgcatgccgatcgcctctatcccgccggccatccaagcctgttgtcccaacccgcatctcggcgcaccacattgcatggtgagcgggaaatggactggagtcattgggcggtcgaggccggaatcgacgtcggccagcaggatcagggattgaatttctccgatcccgggttgctgctcgacgccgcctgtgcagggcttggcattgccctggtcagtcaattgctcagccgtcaggcgcaggctgacggcgtgttgcaagcgctggtggaggacaccattcgcgggccgaactgggcgttgctgacgcatcgcgacagtgagcatgatccgctggcgaaaagctttatcgcctggctatcaacccatttgagcgttgatcaaaccaccgaaaaggcaccggcgcccaatctgccttccagtcgaccgtgaagcacatagtgctgatagccacttgagaattcaccggtggacactgcgcgcctgacatcctcgttcaatcggaaatactgcgcctcgtcaaagttttcggcactgacctcgcccgcacgcccgagcaactcgctgtccacggcaaggcccatgctgctgaggttctcgaaatcaatgatgcgattgaccgcgtgttgctccagcaccccttggttggggaacatcgagtagatatgcatgcccttcttggcgcagcggctgcacatgtcgacacagtttttctgcgtgttcttgcgctgcatcagttccgcaaccggcatgtcgaggtacttgccgacctgatattcgttctgattgaagatcgtgcagcacaggatcgtgttgccattgcagtcgatcaccagccagtcatccttgagcaggcaatcttgctgagggtactgccgggcaacattgacaatatcgtcgtagggcggcagcgccagtcttttcagggtttcataatcggtatcggtgacagaaggatcgcgctcgataatggccagcgttttctccaacggcatcatcaccgaataaccggtggtgaacttgaagccgaggcgctcgctgaactcacgcatcaacgcttcctcttcgatgttatcgaggtagcggtgatagtagacatcgacacgggtactcaaacccaatcgctgcttgatctcgtgcagcgcaatcatgttctgttttacaacttcgatatcaccgcctacatgaccctttacgtaggtgtcctgataaaagcctgacagcgaaatacggaagtaacccggttcggccaacaaggccttttccatgttcttggcgagattgaggttggtactgataccgctgcccatcccggcggcattgatgatctcgatgaattcgccaatttttggatgaaccagaggctcggtccagttgtacagataaatcgacttgaccccttctgtgcgggccttttcgacgatctgtttgaacatgtcgatctgcatggcttttttgaagttgaggttttccgagttgcccattgggcaagaggggcagctcaggttacaggcgccgacaatatcgatgtacatattcattgcgaggggaagctccagagttcgaaagtcatgcatctcatcactgcacgctttcaagtcgccgatcgagttggttttttgacggcattactgcgcaagctagcaataaacgcaccacttttctaaggcgccatcaacgccacaacccaatcgataaacactcgcaacttcaggctgacatgccggttcggtggatacgccagataaagcggcatagggtcgagccgccagtcttggaacagtggcaccagttcgccgcgagccacatgggcatcggacatgtaagtgggcagccacaacacacccatgcctgccaggcccgccgcgaggtaagcattgccgtcatcgaccgcaagcacgtgacgccctttgatttgcagcttttcgctggcgttgtgcaaggcatacggcagcggtttgccggtgcgcgcccagaggaagccgaccacccgatgatgggaatcttccagttcctgtggatgcccaggcgtcccggcccgagccaggtattgcggcgcggcaaacacacccaactgcagatcggcgaccttgcgggccatcagcgacaggtccatgagttcaccaccacgcaccacgcaatcaacgttctcatcgatgatgtcgacgatgcggtcgctgacccccaggtcgatctggatatccggatatcgtgcgtgaaactccggcagcgcaggaatcaggatcaatcgcgcaaacggactgggcacatccacacgcagccgccccttggggagcggcgccgcaccgggcaggctgctttcggcgtcttccatgtcggccagcaacttgatcacacgctcgtagtaagcggcgccatcggcggtgacgttgaccttgcgtgtcgtgcgattgagcaacttcactcgcaaccgcgcctccaactgctgcaccaactgagtcacggtggttttgctcatgtgcagggtttctgccgctttggtgaaactcccggcctcgaccacccgcacaaacgcttgcattgcatcaaatcggtccaatgatcgcgcctcgaatgtttgagaatcacaaacagtgaacgccaagcttgcgcgtttatcgctcgcctgcaaatacctacagtggctccatccactcacatgaaggagccccttccatgactcagcgcgatgttgtatttccacccgcacgccgcaccctgtatgaacgccatcgttactcgccggccattcgttccaacggctttctgttcgtctccggacaagtcggcagcaccgaggacggcacgccagagccggacttgaaaaaccaggtgcgccaggctttcactaacctcaacgcaatcctcgaagaggccggtggcagcttcgctgacgtgatcgatgtcaccgtattcatcgttgacccgccagcgaagttcgagacgatctgggatgtcgttctgaccgagttctggggcgaggcaccgcacccgacggtaacggcggtaggcgtgacctggctgtatgggttcgatttcgagatcaaggtgattgcgaagttacccgacgcgagctgacagagcgattcggccattcataccaccctgttgcgcccgctctgtttggcggcatagagccgctcgtccgcgagtttcaagacgcttgccgctgtcgcagcgtccgcatcgcgacacgccacaccgatggacatcgtcaaccttcccacctgcggcacctcggtttcctcgaggtgcgcgcggattctctgtgcgaacattcgcgcggtctccagagaggcgtcaggaagaatcagcgcgaactcttcgccaccgcaacggcacgcaagatcgcccgaacgcgagttctgtttgaggatgtcggcaacgcttttcaaggcaacgtcgccagcgtcatgtccaaaggtatcgttgacgcgtttgaaatgatctatgtccagcgccagcaccgcatacccctgcccggtctgatccagcagctccaaagaggcagccatggcgcgccgattggccaggcctgtgaggggatcactttgtgcttcatggctaagctgaccgagtttctgttgcagcaactgcacacccgccagcatcgcctggcggatcgcggcggcgtcgcgataccaggcatgcacccgatccaaccgctgcgtggtgtcaggtgctgccaactggtcggcgaccgccgacagctgccgaagtggccgagcgatcagcgtcgctccaacgaggatcagcgcaaggccgaacagacccgctggaatcatcccgacgaccatgtcgcgcatcagttgtcccagcggggcaaggctgcgctcgcgaggtcgctgcaccaccaccgcccaattggctgctggcacccgggcatacccggcgagcatcggcacacctttgtagttgtcaccttgcagggtcccgctctcaccgcgcaaagctgcatctaccgtaaggctccagcccaggacttcgccgatccgcttcgggtccgggtgatacaacagccgccggttgccatcggccacgaaagcgaacgtgccatcgtgatgaaagtggcgactgataatggtgtgaaacgcgctttgctcaagcaaatagacagagccgccgacgatcccgagaaatgtgcctgaggggctgaataccggttgcgaaacgaacaccaccagattgcctgccgaggaaacatacacctcactgaccagaggccggcgctccttgagggcttgttggataccctgcgattgcagcgtggcgccgacaatctgaaggctttgcggatacgcctgaaggacttgaccgctggcatccaggatcgccaccgagttgaagtcggtatcctgtgcctgcaagcgcatggcttccctgcgcaacacctctggtttctcccaatgttcggccagcacagtcgcgctgtaactcaaacgattgtgcgccgcccccagaaactcggcgatgctggacgcgactttcgccgcgtaggcaccgttagcctccagcgtcgagtgaatcagcgcctcgcgctgcacgcgataggcgacgtaaaggctgttgcacagggtcgccacgaccgataacagcacaaacagcagtatcagtccgcgcagatcgatcggcatcggccgggaacgcttcatcccgtcacccgtagcgcggatttccacttctggacaattaatgatgtgagtaacgcttgatccatgaacgaaacttctggtggtgggcgggacgcagtgagcagttgctgccacgttgcgagtgtcatggagaataggcagagaccttgcctttgtcacagcacggaataccgtggtaacagtttctttgagctcgtcaaaagctgcccccccataatcgcgccgccctcttctagatggcgctggcctttgcgcgcatgagtccgtataaccctcgccgattcgtctaccctgagtttgcgcctcacctcgtaatttcagctctaccgacgcccctgaaacggagattcccatgctcaaacaaaccctggcactgaccgccggcctggccctgtccttttccgcgctggtggcacaagccgccgacgtgctgcgcgtcagcgcaattcccgatgaagccccgaccgaactgttgcgcaaattcgaaccgctgggcgcttatctggaacagcaactgggcatgaaagtgcagttcgtgccggtggccgactacccggcagtggttgaagccctcgcgaccgaccgtctcgacatggcctggctgggcggtttcacctttgtgcaggcgcgtctgaagaccgatgcaacgactccggtgatccctctggtgcagcgtgaacaggatgcgcagttcaccagcaaattcatcactgccgacccgaacgtacacagcctcgctgacctcaaaggtaagaccttcgcgttcggctcggtatcgtcaacctccggcagcctgatgccgcgttacttcatgctgaaaaacgacaacatcaagcctgaagcctatttcagccgcgtcgcctactccggtgcgcacgacgccaccgtggcctgggtgcaggctggcaaggtcgacgcgggcgtactgaacgccagtgtctggcagaagctggtggatgccggcaaggtcgacaccaacaaggtcaaggtcttcgccacgacgccgacttacttcgattacaactggaccgtgcgcggcacccttgatccggcagtggcggcgaaaatcaagaaagccttcctggatctggacccggccaaccctgaacagaagaagattcttgatctgcaggccgccagccgtttcatcgacaccaagcctgagaactacaagggcatcgaggaagccgcccgcgccgccgaactgctgaaatgaccctgagcctcacacagggcagcctgcgccacgccaatggcgtcgacgcactgcgcggcgtcgacctgcagattggcgcgggcgaacaggtcgccatcatcggcccgtccggcgccggcaaatcgagtttgctaaacctgctggccaccgcgctgcggcccagcagcggtgagatcgaagtgcttggcgaacgcgcctggcacttgtccgcccgccagcgccaacgcctgcgcgcgcgtatcggcctggtgcatcaggcgccgccgctaccgccgcgccaacgcgtggtaaccgctgtgctggctggcaaactcgggcaatggagcctgggcaaaagcctgctcaacctgttgcatccactggacgtgggcggtgctcgcgccgttttggcacggctcgatctgggcgacaaactgttcgctcattgccagcaactgtccggcggccaattgcagcgcgtcggcatcgcccgggtgttgtaccaggcaccgcaaattctgcttgccgatgaaccggtgtcagcgatggacccggtgatggccgggcacaccctgtcgatcctgtcgcggcatgcccgcgagcacaacgtcacgttggtggcgagcctgcatgcagttgacctggcgctgtcgcactttgcgcgggtgatcggtttgcgcgacggccagatcctgttcgacagcccttccgggcaagtcagtgaggaaatgctcgacgccttgtacgccaacgaaaaactgcaatcgccggccgctgcagtcgcaccgctgactgtgcagattccacgatgctgagcgccgattcacgcgatcctgcggcatggccgcgactgctgctgagcgtcctggcgattgccttgctgtggccgggtatccagctcagcgaactggatctgggcgtgctgctgcaagatgacagccgcagcgaaatgggtcgtttcgtttcggccttctggccgcccgcgcacgatcaagcgttcttgcagctgttgctcaaagccacgttgcaaaccctcgccatcgccaccgccggcatggccctggcgctgctgctggcggtgccggccgggttgctggcgagtcgtgcgctgtcgttgtccgccgcctcgcgcggtggcgtgccgagcgccatgggccggttgttacgctggccgattcgcggcttgctgatctttctgcgtagcgtgccggagatcgtctgggcactgttgtttgtccgcgcggtcggtctggggccagcggcgggcgtgctggccatcgccatcacctacagcggcatgctcggcaaggtctacgcggagattttcgaatccaccgatcagcgcccggcccacgccttgctgcaatcgggcagcggccggctggcgagttttgcctatggcgtcatgcccaatgtcgcggcggaactgctctcgtacacggtctatcgctgggaatgcgcgatccgcgcgtcagtggtgatgggttttgtcggtgccggcgggctcggtcagcagatcgatctgtcgatccgcatgtttgccggcggagaagtcgccagcatgctgctgaccttcctgatactggtgctggccgccgatcaattcagccgtttgttgcgctggaggctggcatgaaccgcctgatcaatctgctgctggtcaccgctatcgtcgcggcggtctttgcctcgttcagctatctgggcctggatctcgctgagcttggcagcgccagtagcctgaagcagatgggcgcttacgtgcagcgctttctcagtccggacttgagcaccgcttacctgcgagccattgttcacggctcgatggaaaccctcgccatgtcggccctcggcaccctgctcgcggcgatgctgggaatcatcctcgccctgcccgccgccgggcgtttcggctggccgctacaaagtgtttcgcggctgttgctcaacggtttgcgggcgattccggaactggtctgggcggcactgatggtgctcgctgccgggcttgggccgaacgccggcaccctcgccctcgccctgcacaccacgggcgtgctcggccgcctgtttgccgaagccctggaaaacaccccgccgcaacctgccgaagcgatccgcttgcaaggcggcaatccgcttctggcgttctgttacggcaccttgccgaaccttacgccacaactgctcgcctacattctttatcgctgggaaaacaacatccgcatggccagcgtactgggttttgtcggtgcaggcggactgggccagatgctctatgtgagcctcagcctgtttcaggaggcgcaagccagcacggtaatcctggcaatgctgttgctggtgttggcagtggattcgttgagcgcctggagccggcagcgctgggtcaaggcgtaaacagcacgcctcgggcagtcctgcggcccgctgcacgtcggcaggcgcgatgccgcagcaacgcgcctgccagtcacttagtgcggtgcgcgcgggatggttttcatcaggtcttcagggctgatgtggccgaccacgctgcccggttgcggcagattgagaatgtggcccttcattttgccgatgatgtgcatctcgcacggtttgcagtcgaatttcagtgtcagtacttcatcgccgtggatcaactgcatcggcgcgaccttggtgcgcacgccggtcacgcccttggcctgtttcgggcacaggttgaaggagaaacgcaggcagtgcttggtgatcatcaccggcacttcacccgcctcttcgtgagcttcgtacgccgcgtcgatcagcttcacgccgtgacggtggtagaagtcgcgcgctttctgattatagacgttggcgaggaaggtcaggtgcgaatccgggtacaccggtggcgggctggtttcagctttgcggtggccacgcgggtgcgcagcgacacgggcggcggtgaggttctcgatcacttcacggcgcagggctttgagctgcgagttggggatgaagaacgcctctggcgcatccagcttgatgtcggtggcgtggtactgcgtggtgccgagctggccgagcagatcgcgcaactgttccagcgcctgctcaggcttgttggcgacgccgaacggaccgttgagggtgacgctggcactgatgccttcctcgctggtggcggtcacttccagctgttgttcacgcagacgcgcaacccagctcagggccacgcgacgctccgaagaagtcttttgcagcgcctgttgccagttgtggtcgaggttgcggttcaacgggtgattcggtcgcagcttgtacaggccttcgggcatttcgttcggctcgacgcggtagcggtaacgcttctcgccgtcttcctcgaactcgcctttggcctcggcgatgttggcgcggaaaccgaccacttcgcgcttgaccaatacgttcaggccatcaccgttggacagcggctcgtgggtcaccacttgcatgtcacgcttggcgactttctcgacgatgccgaccggcagaccggtgaaggtcggcgagtcgaaagcgccgatgtcgatcttgcgatcagtgacaaaatagtcggtgctgccacggtggaaggttttttccgggtcaggcaggaagaagtgcgcggtgcggccgctggaagcgcgggccagatccgggcgatcttcgagtacgtcgtcgaggcgctgacggtaataggcggtgatgttcttcacatagcccatgtccttgtagcgaccttcgatcttgaacgaacgcacaccggcttcgaccagcgcgcggatgttggcgctctggttgttgtctttcatcgacagcaggtgtttttcgtaggcgatcacgccacccttttcatcttttagggtgtacggcaaacggcaggcctgcgagcagtcgccacggttggcgctgcgcccggtctgcgcgtgggaaatattgcactgcccggagaaggccacgcacaacgcgccatggatgaagaactcgacggcagcatcggtttcatcggcaatcgcacggatttcctgcaggttcagctcacgggccaacaccagttgcgagaaaccggcctgatcgaggaatttcgctcgctcaagggtgcggatatcagtctgggtcgaggcgtgtagttcgatcggcggaatgtccagctccatcacacccagatcctgcacgatcagcgcatcgacaccggcgtcgtacaactggtggatcagcttgcgcgccggctccagttcgttgtcgtgcaggatggtgttgatggtggtgaaaatgcgcgcgtggtaacggcgggcgaactctaccagttcggcgatttcaccgacttcgttgcaggcgttgtggcgcgcgccgaagctcgggccgccgatgtacacggcgtcggcgccgtggagaatcgcctcacgggcgatggcgacatcgcgggcagggctgagcaattccagatgatgcttgggcaaggacatagtttttttagtcaggctgtcacggttaggcgcgcattctacccctgaaacgcgtaccgggcacgcctcggctgcccgatggccggggcggcgcgacaaaggcctgcgcatgctatcgacgatgacgcgccgtcgaggctgcacttacaatgcgcgaaccttttgcattggcccgcccatggacatcgacctcgctcgcaccttcctcgaaatcgtccgccacggcagtctcgccgccgccgcgcagaagctcttcgtcacgcaaacggcgatcaccgcccgggtgcagaaactcgaaagccagttgggcagcaccttgttcgtgcgcaatcgcgccggggcgaaactgacgcccaatggcgaggctttcgtggtctacgccaatcaactggtgcagacctgggaagcggcgcgccgggatctgccgctgcccgagggttatcacaacgtgctgcacatcggtggcgaagtcagcctgtgcaatccactgatgctcagttgggccgccgaactgcgcgaaaaaatccccgggcatgccctgcgcatggaaatccgcgacggcgaaaacctcctgcgccagctcgaactcggcgtactcgacgcggcgctggtctatcagccggaatactggccgggactgcaagtggagcaagtgctggaggaaaaactgattctggtacgtgcgcccgagcgcccggatccctacgtctacatcgattggggcccggacttccgccgtcagcacgacgccgccctgccagaaaaagccaaagccgcgttgagtttcaacctcggcccgctggcgctgcaatacattctcgaacacggtggcagcggctatttccgcacccgcgtcgtgcgtacctatctggagagcggcgcactcgaagcggtgaccaaagccccggaattcagctatccgacttacctggtgtattcgcgcgatcgtgactcggcgatcctgcaacaggcctttgacctgttgcgcgacgtgatcaaggccgatgacgactggtcgcagcgctggaacccgttgagctgaaccggccgctttacaccggatcatggcgcatgtgacctcaaggtccggcctgcacaaacggccggatcggctaatctgccgggtataacaacgataccgacaggtgagcgcagtgaggcagaccaccgaggcatttcgcagccgctaccgtgcggccattcacccgctctacaacccatggctgcacggcgctttcgtgctgctgttcggggtattggccatcggcgccttctggagccgcgtgcaacaggtcagtgggctggaatggctgacggtgccgctgacgctgttgttcttcaacttcggcgtgtacacggtgcaccgccatctcggccaccacaaaaaggcttttgccaaactgttctacgcccgccacgctggcgaccatcacagttttttcacccccgggcacatgacttacgacagcgctcgcgactggcgggtgattctgtttccggcatggctgatcgtcgttcatacattgctgatcaccctgccgttatggtggttgttcgcgcaattcaacgccaacgtcgccgggctgtttggtggttgcatggtcctgggttatctgacctatgaagtgtttcatgcctgcgagcatctgccgccggacaacccggtgacgcgcctgccgtggatccgccagatgcgccgcctgcacgaactgcatcatcgccgcgagcgcatgcaggagcgcaatttcaatatcgtcctgccgttgatggactacctgttcggcaccctgtactgggaaccggaacccgcccctttgagctattcgagaatgcccatgacccgcatgcagcaccagatcgatatcaccggtgaaccgattgccgtgctcgcctatgccgccagtgtcgggcgctggccggagtggcacccgtcgtcgctgaagatcgacggcccgcacggcccgctgcatgccggcgcgcgctttgaagaggacattcatgccggcggccgtgaaggccacttgagctgggaagtgactgagtacctgcccggccgacgctggtgcgcgcgggcgcagggcgatcatggcttgtcgttgctgctgacctatgaatgcggcgccgagggtaacggcacgcgatttgtgcgcacactggattatcgcttcgacggcttgggcatgcgcatcgccaatcacttgctgctcaagcgccgcatcgagcgcgaatctgccgcgtcgatgctggcgctgcgtgacatggccgcgcaatacctgtcatcggcgagggccagcgcgtgaagctgcgacatctgctattgctgctggtgctcatcgtcatcggttttttattgttgatgccgagcagagtcgaacccgtggcctggacgccgccgccagcgccatcgctcaaagaaggcatttacgccgagaaccagaaactcaaagccgcagctcaggtcgggccgagcgacatcgaggggccggaagccttgctgctggaaagtgacttcttgatcaccggactgcacgacggccgactgctgcgcaccagcctcgacggccagcaacgcaaagtactcgccgacaccggtggccgtccgctcggtttggcccgacatccgaacggcttgctggtgatcgccgacggggtcaagggcttgctgtcccttgatgcgcaaggtcagttgattcctttgaccacggcggccaatggtctggcgttcggcttcaccgatgacgtcgccatcgacaagtccgggcattacgcctatttcagcgacgcttccagtcgttggggctatggccatgacggcgaagcgatcatcgagcacggcggcgacggacgcctgctgcgctatgactttcagacaggtaaaaccagcgtgttgctggataagctggaattcgccaacggcgtgaccctcggtccggatgacgcctatgtactggtcaatgaaaccggcgcctatcgcatcagccgttactggctgaccgggccgaaagccggcactcacgacctgttcatcgacaatctgccggggctgccggacaacctcgcgttcaatggcagcaaccgcttttgggtggcgttgtatgcgccgcgcaatgccttgctcgatggcaccgccgggcaccccttcgtacgcaagatgattgtgcgggcgttgacagttttgcctaagccggtggagaagcgcgggtttgtcctggggctggatctggagggcaaggtgatcgccaatctgcaggatgccagcaacggcaattattcgccgattaccacggtgcgcgagtatgggtcgtggttgtattttggctcgttgaaggccacgcatatggcgcggatgccgttggatgcggcgctgaagtgaatctgctggatttgtatcgagcggattgacgccatcgctggcaagccagctcccacagggttctctgctgaccacagcatttgtggtcaacacaattcactgtgggagctggcttgccagcgatgacggtctgtcagttgctggacttatcgaacttgtccggatcttcgtcttcaggcaaatcctcatccggctcttcggggttagcggtggtatgcgccgggctgttgggttcgggatgggtaggaaccgggtcgaatgcgccctgctcttcactggggaatttcggatcgttcataaggcacctcgcaaagagtcggggattgaagactctgtacattcgaggtgccggtcgtggctgtcgttcccgtcaatccgcaaccgcaggtcggcggatcaatggagagtcaggacggggcctgtaaatggctgacgatttcgtctttcaccttaaggcgcttctctttgagtttttttaatgcatcgtcggtgggagcatccgaggtggccgtttcggccttgaccacgtcggcgtcggcttgggaatacttgttgatcagtgaatccagtcgtggatcctgggtgcgtttttgctggatctcttccttcgtgcaactcaagtcctgaaacaggtcatggggaaccggcatggaacacctccgtcagttgatcggcagccagcgcgaccgatgcgctggcccgttatcagaatggccttggttgagccgttctgtcgaccacctgtcagaccagcggtggccgttcgtcgccctgtcgcaaatgcgataaaacctttgtctgcagcgttgcctccattggataacaccgacaacaacttgcgtggagatacaccaatggacggattcaacctgcgtcatctcgttttggctgtcgccctgagcagtggcatgggcagtgctttcgccgcgacggacaatgacttcgtcgataacgccgcagccggtggcatcgccgaaatcgaaaccagccgtctggccctggaaaaaagccaatcggctgatatcaaggcgttcgccaacatgatgatcaccgatcacggcaaagccaacgatgaactggcgaccattgccaaggccaatgacatcgaagtcccggacaccacgactctggtcaaacaggccaaggaaaaaatcctcgacctgcgcgatgaatccttcgacgccgcttacgctaataatcaggtgaaggcgcatgaagagaccatcgagctgttcaagaaacaagccaataccgtgaccgatgacaaggtcaaaggcgctacggaattgaaggcctttgcccagaaaatgctgccggggctggaaaaacacctcgcggctgccaaggaattgcaggccaagcatccgagcaagtaaacagccttaccctcaccccagccctctcccaaaaggagagggagcctaccgtgttggatggtcgagctacgccgacttgaaagtattgagttgaactcaggtatgaacagccgccgacctgaaatctcgagttgaactcagcttttgaaaagcaccaagatcggctcccttccccctcgcccccttgggggagagggttggggtgagggggatcgatctcagccacaccaccagactcaagcaaaaaaaaggccgcacccactggatgcggccttgtcgtatccgccgaacatcaacccccatcggtatcaatatcggcatccgtctcctcccccggcttagcccgatccggctgcggttcgaagcccggactgaactcattgtcgttgtccgtgtgctggtttttctgatccaccgccggatcggcactctgcgcctgctctttttcgccctgatgctgcgtcggcgccggctgccccggtacctgcgggtcgatagccggatcattgcgattgattggttcgccagattggctctgcttcgtttgctcgttcatggccacctcgttggtcaaacacccccgacacacatccgccgggtgttaacgattcgaagcctgacccgcgccatcgttcaaaacatcgccgcttgcggccacgccgactagagttaccgggacgttacttgcgccagatcaaaaatatacgtgcaggaacgaacaactatttcgaacggcaaatgtcgatcacttcgcggcgatcattttcacgatcgccccccaattcgcgacggagcaacaggcacatggcagcactgcagaacagcacactcgatgcgatgaaaaacaaacaagcacaactgctgggcgaatggatcaacggcctgcaagccagcggcgccacgcgtaacctgaaagagcacgatctgcagcaacagaccacggaattcctgcaactggtggtcagtggcatcgagaacgacaacggcaccaacatcgccgcacccggttgggagaccacccgccagtttctcgaaaagctctcccatagccgcgccctgctcggccaggattcgcagcagaccgccagtttcatcttcgccctcaaaggcccgctgtttaacctgctccaggcccattacaaagaccagcctgcactgctcgccgaacagctctgggaagtctccgagctgctcgacgcgttcggcatgcacaccatccgcaccttccagaaatcccgcgaggcggtgatcaagcgtcaacaggaagaactgctggagctgtcgaccccggtggtcaagctgtgggatggcgtactcgcgctgccgatgatcggcaccctcgactcgcagcgcacccaagtggtgatggagtcgctgctgcaacgcatcgtcgacaccggttcggaaatcgccatcatcgacatcaccggcgtgccgaccgtcgataccctggtcgcccagcacctgctgaaaaccgtcaccgcgatccgcctgatgggcgccgactgcatcatcagcggtgtgcgtccgcaaatcgcgcaaaccatcgtccacctcggtctcgacctgcaaggcgtggtgaccaaggccaatctggccgacgcattgaaactggccctgactcgtctgggtgtcagcctcgtcaagacggtataagcatggaacgtatcccgattctccagatgggcaagttcctgctggtgaccattcaggtcgatatgcatgaccaactcgcccttaccctgcaggacgacttgtccgagcgcatcagcaagacttcggcacggggcgtgctgatcgacatctcggcgctggacatggtcgactcgttcattggccggatgatcagcacgatttccgggctgtcgaaaatcatggacgccgaaaccatgctggtcggcatgcagccggcggtggcgatcaccttggtcgaactcggtctgaccctgcccggggtcagcacggcattgaacgtcgagcgcgggatgaaactgctgcaggaacgagtagaccggcaatgaccgtacgcagcagcggtactcaacccatccacatcgagcaggatgtcgtgctcgcgcgccagaccgcacgcaaactggccaccgaatgcggcatgcgcctgatcgacctgacgaaaatggtcacagctgtcagcgaactggcgcgtaacaccatggtttacggtggtggcggcgacatggactggcagattctcgatgaagatcacaaggtcggtctgcgcttgaccttccgcgacgaaggcccgggcattgccgacatcaagctggcgatgaccgacggctggacctccggcagcggcatgggcctgggcctgaccggggcgaaacggctggtcgaagagttcgaactcgataccgagcccggcaaaggcacacgcataacgatcacccgatggacatgaatatcgtggggacgttgacccaggttctgccaatcgaagacagcagtcagatcggttatgcccggcgcaccgcgcagcaactcgctgaacagcatggctttgacgagcgcgatgccgggcgtgtcgcgttggttgccactgaactggcgagcaatgtgctcaaacatgccactcacggcgcactgcatcttcgagtattacctcggcccacgggtttcggcatcgagatgctcgcggtggatcgcgctcaaggctttgatctggaggcctgcatggccgacggattctctacgggcggcactcaggggatcggcctcggcgcggtatcgcggcagaccgaggtgttcgatgtctatgccgacgcgcgtggcgcggtgttgctggcacgactttacccacgcaacgaccgcgaaccggatatccgctacggcgtcagtcagcattcgttgcacgacgatccggcgtgcggtgatgtctggcacctggcgtatgaaggcgccagcatcagcgcgctggtgatcgacggcctcggccatggcgaggaagccgaacgcgctggccgcgccggcgccaaaaccttcgccctgacaccattcgccgaaccggtcatgctgatggaagacctgcaccgcgacatgatcggcacgcgtggcggcgccgtcgcgtttacccagtttgacggcaggcgcgacagcctgaccttcgctggcgtgggcaacatcggcgccagcctgatcaacgccgacaagtcccgtggactgccctcgcacccaggcattgttggcgtgcaataccggaaagcccggccctttgactatgctcacgtgaacggacatctattgatcatgtacagcgacggcttgcagtcccgttggaaccttcaagactaccccggcctggtgcaccgccatcccgccgtgatagccagcgtcctgcaccgcgacttctgtcgcgggcgcgacgatgtaacggtgctggtcgttgccctggacgccgcccatggctgagtcgccgattctgagcagtgccgagcaggccacgctgattgcccagttgcagagcgaaaccgctgcgctgcgcgaagaactcgatgaaaccaatcagggcgtgctggcgctgtacgccgaactcgatgtacaggcggaggaactgcgccaggcttcggatctgaaaagccgtttcctgtcgtacatgagccacgaattccgcacgccactgggttcgatcctgagtatcaacagcctgctcgccgacgaactcgacggcccgctcagcccggaacagcacaaacaggtagcgttcgtcagcacggcggcgcgcgaactcagcgacatggtcgatgacctgcttgatctggcgaagatcgaggccgggcgcatcaccatttccccggcctggttcgacatgttcgacctgttctcggccctgcgcgggatgttccgaccgatcgtcgacgcctcggcggtcgatctgatcttcgaagagccggtcggtttgccacggctgtacaccgatgacaagaaactcgcgcagatcctgcgcaacttcatttccaactcgctgaagttcaccacccgtggcgaagtgcgggtttccgcgcggctcgaaggggcggacaaggtgcgctttgccgtcagtgacaccggaataggtatcgctgccgagttgcatggcgcattgttcgaagacttttcccaggtcgactcgccgttgcagaaacgtctgcgcggcaccgggctgggcctgtcgctgtgtaaacgcttcgccgccctgctcggcggtgaagtcgggatggacagtgcgccgggggtcggctcgacctttttcgtgatcatcccgttggcgatcgctctggagaacgtcgatgaaacgtgacatccgcctgttgatcgtcgacgacaacgtcgccacccgctacgccttgcgccggcgactggagcgtcacggctatgaggtgctggaggccggcaccggcagcgaggggctggcgctgattgaaagcgaaacgctcgacgcgttgatcctcgacgtcaatctgccggacatgagcggtttcgacatcgtgcggattctgcgcgcggacagccgcacggcgctgctgccagtgatccatgtgtctgcggcgtcgatccagaccggcgacatcatcaccggcctcgacgccggcgccgatgcctacctgattcacccggtcgatcccgacgtgctgctggccaccctgcgcacgttgctgcgggtacgcgacacggaaaatgccctgcgcgaaagcgaggcgcgcttccgcgagattttcgtcaatgtgtccgcgccgatcgcggtgctcgatgccagcctcaaagtgcatgagtgcaaccatgccttcgcgcaactgattctcgacaatcaggacccgcaaatcctgcgtgaatgcttcgccgaggagcagagcgccatcctcaatgaactgcgcttgcgcctggtcgatggcgagcgctggaaaggcacgctgaacatgcgcgtgcagggtgagattcgcgaaaccgagtggcagatttcaccgtaccgcacgccggaactgagcctggtgttcgtcgaagacgtcaccgaacaccgccatcgcgaacgctcgcatctggcccgccttgacgacaccaccacgcaactggtcaaggaaaccgccgaacgcgtgcgggccgaggcgcaattgctgcaagtgcagaaaatggatgcgctgggcaagctcaccggcggcatcgcccatgacttcaacaacctgctgaccgggatcatcaccagcctggaactgatccagaaacgtgtcgccgacgagcgtctggacaaagtgcagttttattccgaagcggcgctgaattcggcaatgagcgcggcgtcgctcacccatcgtctgctggcctttgcccgccagcagcctttggacacgcggccggtggacatcaacgagcacgtacgttcgctggaagaactgctgatgcgcaccatcggcgaacgcatcaccctcaagctcgagctgaccaacaaaccggcgatcgccctggtcgacccggtgcagctggaaagcgcggtattgaatctggtgatcaacgcccgcgatgcgctgccgacaggcggcaatgtctgggtcagcacctacgccgcctattcccatggcgacccgaatctggccgacggcgcttacgtggcactgtcggtgcgtgacgacggtaccgggatcgaacacaacgtcatcgacaaggtcttcgatccgtttttcaccaccaaaccgttgggccaaggcactgggctggggttgtcgacgatctatgggtttgcccgtcaatcgggtggcgatgcgcatatccgcagcgtggcgcgacgcggtaccgaagtgacgatcatgttgccggccaccaccgatccgactggggctgacatccccccacccgtaatcgatccgcaaggcagcggtgagcatgtactgattgtcgaagacatgccgtcggtgcgcatgtttgtcaccgaagtgctggaggacgcgggttatcgctgcacccaggcggcggatatcgaaacggcgctggagcgcttgcagaacgatgaatcaatcaacctgctgctgaccgatgtcggcctgccgcgcatgagcgggcgcgagttggcggatgttgcgcggggctggcgtgatgggctgccgattctgttcatgaccgggtatgcggaaacggcgatcaatcgccaggtgtttctgggcagtggcatggatatgctggtcaagccgtttcagatcagcgagctgctcgacaaggtccgccgcacgctcgatggtgcctgagccaatgctttcgtgagcaagctcccacagatatttctgtagattacagatccaatgtgggagcgagcctgctcgcgaaggcgttagctcagtgacttcatctgtgactgacactccgctttcgcgagcaggctcgctcccacagggggcttgtgtgttctgttatccagttcacaccacaaaaacctgtggggccagccggaacaccgcaattaccggctcaaggcccgggccaaaaacggtgccgtcctgctcttcttgctcgccgcaaccttctgcggcgtgcccgccacgacaatcctgccgccctgatcccccgcccccggcccgatgtcgatcacccagtcactctgcgcgaccacgcgcatttcgtgctcgaccacgatcaccgtatgccccgccgtcaccaacgtatccagctgttccaatagccgatcaacatcgcgcggatgcagcccggtggtcggttcatccagcacatacaaggttgcgccgcgctggttgcgctgcaactcggtggccagtttgatccgctgcgcttcaccgccggacagctctgtggccggctgacccagacgcagataacccaggccgatgtcacgcagcacttccagtgaacggcgaatccccggttgctcggcaaacaccgccaccgcttcatcgacggtcaattgcagcacctgcgcaatgctcaagccatcccacaggatcgccagtgtttgtgggttgtaacgcgcgccatgacaggtcgggcatggcgcatacacgctcggcatgaacaacaactccacactgacaaagccttccccctcgcacgtggcgcaacggcccttggcgacgttgaaggaaaactgcccggcgtcatagcccgcctcacgtgcttcaggggtcgcggcgaacagcttgcgcacgttgtcgaacagcccggtgtaggtcgccagattggaacgtggcgtgcggccgatgggcttctggtcaacctgcaccagtcgcttgatcgactccagcccagacgtaacctgaccgctgctgagctgcggtgcgtcgtcttcgaggctgagttcttccggttcgctttccactgttggacgccccaactgcgcgccgaccagttccagcaaggcctgactgaccaggctcgacttgccggaaccggagacgccggtcaccgaggtgaagcagcccaacgggaattctgcgctgaggttgttcaggttgttacgggtgatgccgtctagtttcagccacgccgtcggtttgcgcgccgttcttgtctggcgttgcgattcggcaaacagatacgcgcgagtctgcgattgttcgatcgcggccagtcctgcaggtgggccgctgtacagcacctgcccgcccttttcccccgccgccgggccgacatcgatcagccagtcagcgcggcgcatggtttccaggtcatgctcgaccacaaacagcgtgttgccgtcagccttcaagcgttgcaaggcctcgaacagcgcctcaccatcggccgggtgcaaaccggcggaaggttcgtcgagcacgtaaatcaccccaaacaattgcgagcccaactgcgtcgccaagcgcaagcgctgcaactcacccgacgatagcgttggtgtgctgcgctccagcgccagataaccgaggcccagatcggtcagggtgctgacccgttccagtaaatcctcggcaatgcgctgcgccgccaagcgtttttccagcgacaggttcggcgtgtgtcgcacatccggcgcactgccatgcccgctggcaccatgggccacgcgctgctggcgggcttcgcgggtttgcgcgtggctcaaggtctcgccggtttcctcggcgtgctccagataactttgcgctgccacgggtttcaaaacctcggccacttgcaacaacggcatctgcgacaactcgccaatgtcgtacccggcaaacgtcactgacaacgcttcgcgcttcaggcgcttgccatcgcacaacgggcaagggctgccgagcatgaattgcgagacgcgcttcttcatcagcgcactttgcgaatggctgaacgtgtgcaggatgtagcgccgggcgccggtgaaagtgccctgataactcggctccatcttgcgtttgagggcgatgcgggtttcttccggggtcagcccggcgtacaccggcacggtcggggtttcctcggtgaagaggatccagtcgcgctgctttttcgccagtttcttccacgggatatcgacgtcgatgcccatggtcacgaggatgtcgcgcaggttctggccctgccacgccaacggccaggacgccacggcgcgctggcgaatggtcaggttcggatccggcaccatcagcgcctcggtgacctcatagacacggccgaggccatggcactccgggcaggcaccttgcggggtgttcggcgaaaaatcctcggcgtatagcatcggctgccccggcggataactgccggcgcgcgaatagagcatgcggatcaggctcgacaacgtggtaacgctgcctaccgacgagcgcgtgctcggcgtgccgcgttgctgttgcagggccacggccggcggcaggccttcaatcgaatcgacgtccggcacgccgacctgatcgatcagccgccgcgcatacggcgccaccgattcgaagtagcggcgctgggcttcggcatacaaggtggaaaacgccaatgacgacttgcccgaaccggacaccccggtgaacaccaccagcgcatcgcgggggatgtcaacgtcgacgttcttcaggttgtgttcacgcgcgccacgtacccggaccataccggcgggcgctttggaggtacgtttggaagtcatcgacctgccttggtgaaggaatgttcaacgctcagctaccgagcactacgcgaatcatctgcaacatggcctccgggctatacggtttgccgagcaaatgcgtgtcgggactgagctggtgattgcgcgagatgatgtcgcgggtgtgcccggaggtgaacagcaccgccaccggcggcgtctgcaccttggcccaggcgaacaggtcggagcttttgatcagccccggcatgaccacgtcggtgaagatcaggtcgaccgcgacaccttcgaggagcatttgcatggccgcatcgccgtggccggcggtcaacacgcggtaaccctcctcacgcaacaactcgaccgccgaggcgcgcaccgcgtcgttgtcttcgaccaccagaatcgtctcgtggccgccactctgctgcctttgcagattggctgactcatcaaggatcggtcgcaagctacgcggaaaatacaattgcacccgcgtgccctcgccaacggtactgacgatctcgacgtggccaccgctctgtttgacgaaaccgaacaccatgctcaggcccagcccggtgccctggccgtcggccttggtggtgaaaaacggttcgaacacttgctcgagaatgcctggcgcaatgccggcgccggtgtcactgacggcaacgcggacaaactcgccggggacgatgcctttaccggcgcagaactcgcgatcgaggtgcacgttggcggcgctgagtgcaatggtgccctcgcccttcatcgcatcgcgggcgttgatcgccagattgagaatggcgttttccaactggttgcggtcgacattgatatgccacggttgctgcggcaactgcacatcgatctgaatggtttcgcccagcgctcgctgcagtaattcgccgacaccttcgaagatctgccgtggattgcacactgccggcgacaacggctggcgccgggcaaacgcgagcaattgcgaggacagcttggcgccgcgctcgaccgccgccagcgaggcactgacgcggcgctgcacgttggcattgtccggttcgtggcgggcgagcaaatgcagattgccggcgatcacttgcagcaagttgttgaagtcgtgagcaacgccaccggtgagaccgccaatggcttcgagcttctgcgactggcgcaattgctcttcggccgccagtcgcgcctcgacttcttcgcccacacgctgttcgaggttgcgggtaaatttgagcagggattcttcggcgatcttgcgttcatgaatgtcgatcaacacgccagggaagcgcagtggctcgccctgctcgtcgaactcgcaaccaccgctggccagcacccacagataactgccatcgctgcgcaatacccgatattcggcgttatacggctcaccggtctgcacgcaatgggcgacccgctcctgcacccaggcgtggtcatcgggatgaatgcgcgactcggcaatgtcctgagcgagattgctcaagtcctgatccggcggataggagaacgtacgggtgaaacgttcatcggctgacagcgtgttgtttctcacgtcccagacgaaagagccaagcaaggccccggcattcaacgccagacgtacccgctcgttgtcggcgcggtaggcgttttccgcctcctggcgcaggcgctccgagatcacgaactcagtggtttccaccaccatcgccatcaccccggccggctcgccttcgtcattggccacagggctgtaataaaggtcgagccagacatcctccggaacgccgtcacgcaacagcaccaagactttattgcgaaacgacaaggtgccgccggccagacaggtatcgaccacatgccgattgaaatcggcgacttccggccagcccaactcgaccggcgcgccaagcagatacggatggcggcccccggcgaatttcgaataggcatcgttgtagatcatgtagccggcacggccccagagcatgaccatcggcagcggcgacgccagcatcaattgcacggcgctgcacagactggctggccaactgttcagcgggccaagttcagtcccggaccagtcgaacgcgcagatgcgctcggccatctcgcctttccagccttcacaaccatggctatcggataaaaactgcatcgcctgactcagtgtcctgtactggttgtcccgtaaacctcgccgcctgaacgacacgacgcccgtctgtttcgagcgtcttcagtcgtattggtttcattagaggtatagccgatttcatcgccgctcggagactagacgccgatcaggtgcttgagcggatggtagccagttttcatcttggcggcgacgtcgagaatggccttctcgatgccgttcaaatgcatgcaggtgagctcgatggcggcgctctgattgcccgcctcgatgtattcgatcaagcgcaaatgctcgtcgtcgcggcacacttcatgactgtcgtcgtccagcgcagcggcgtacagcgaagcgcgggaaatcagcttctggaaccagtcgagcaacaccgggttgttcaggctgcgcgccagtttgatgtggaactcgccgagcagatgaatcagccgttcgtggtcgcccgccgcgtgggcttgatcttccagcaacaagtgttcacgcagatcctgcatcgccgcgctgtccttgcgtcggcacagttcagtgacgatgccgatctcgatcagcctgcgggtttcgaacagtgaacggatctcttcgttgctcggcagcgacaccgatgcacccttgttgggctcggtggtgaccagtccatcggcctccaattgcttgagcgcggcacgcaccgacgtgcggctgacattaaataattcggccagcgaggcctcgcccagcttcatccccgggcgcaacgaacgcttgctgatcgcctcgtaaaccccttggtagacgcggtcgaccgtggtttccagtttcttttcggtcattcgaacactcctttgacgtcgggcaaccaacccctggcgatgcccggccatggaaaaagggggttgcacacgcagattaatccgggtatttctaaattgcattcagatattgcatacaataaatagaggattgcaccattatgggtcaaccaatagcaattgaagtgcgcaacgtctccaaacgatactccgaggatccaggcctcgcgccagccctcgacaatgtttcggtgaacatcgccgacaacgaattctttactctgctcggcccctctggctgcggcaaaaccaccttgctgcgcaccatcgccggcttcgaacatgtcagtgaaggcgagattcgtctggccggagagccggtcaatgatttgccgccgttcatgcgtcgggtcaacacggtgttccagagctacgcgctgtttccgcacatgagtgtcgcgcagaatatcgccttcgggctcgagatgcagggtcttgaacgcaagttgataccggatcgggtcaacgagatgctcgcattggtgcaaatggaacatctggccgggcgcaaaccagcgcaattgtccggcggccagcaacagcgcgtggctctggcccgggccttggcgccgaaacccaaagtcttgctgctggatgaaccgttgtcggcgctcgatctgaagctgcgcaaggaaatgcaggtcgaactcaagcgtgtacagaaagaagccggcatcaccttcattttcgtcacccacgatcaggaagaagcgctgaccttgtctgatcgcattgcggtgatgtccgccggcaagatcctgcagatcggcacgccgaccgatatctacgaacacccgcaacaccgctttgttgcgcagtttatcggcgacatcaacttcctacccggccagctcaagcacggcgagcacaacgaaaagctcttcgtgcccaacggcatgcccatcgaaatcccctgccagcaacagagctttactggcagcagcgtgcaactggcgttccgcccggagcgctcgcaattggtcgacgccagcgagccgcatcacctgcgcgggatcatcgaagccgtgctctacgttggcaccgcgacgctctaccagtgccgcctgaacaacgacatcaaagtcatgctgcgcgaaaacaacgaaggcctgaaccaaagccgcgcggttggcgaacgcatcgccgtgcacctgccgccgcatgcctgcctgttgatggaggcctgagatgagcgtcagcggcacttcccctgccctcaaccgcgcgctgttgctcagcccggtggtgttgaccctgctcgccctgatcgccattccgctgggaatcatgggctacatcagcctgctgccgcgcaacacctatggcggcgtcgactggcaagcgcaatggcaactgcaaagctatgtgcagctgtttttccaggaaggttttgacggtgaactggaactgaactgggtctatgcgcaagcgttgttgcgctcggtgttgcaagccggcggcaccaccgtgttgtgctttctgttcggttttccggtggcgttgtggatgtcgagcctgaccccgcgccgacgcaacctgatggtcttgctcatcaccattccgttctggaccaacctgctgatccgcaactacgcgtggctgatcatcctgcgcgaacacggttgggtcgcacaaagccttaacgcgctgttgcccagtgccggcggtatcaccctgctctacaacgacttcgcggtgagtgtcggtctggtctacagcttcctgccgttcatgattctgccgatctattcgaccctggaaaaactcgactggcgtctggtggaagccgcttatgacctcggggcgaatcgctggcacgcgttgcgccggatcatcctgccgctgtcgatgcctggggtgattgccggtgcactgctggtgttcgtgccgagcctcggtgccttcatcaccccggcgattctcggcggcggcaagaccctgatgatcggcaacctgatccagcaacagttcggcacggcgcgcaactggccgctgggcagctcgctgtcgttcctgttgctggcgattctgctggtgtcgctggtgctttacgcgctgtacagccgccatgcggcgaagaccatccatcggggggcgaaagcatgatttccctgcacctgaaaaaactcccggcaacccgcgaaatcagcctgctgatcctcgcctatctgtacctgccgatcttcgtgttgatcgcctacagcttcaatgccaaccgctcggcgacggtgtggaccgagttttcgtttgcctggtacgggcggattctggccaacccgtcgattcagacggcggcgctgaattcgatcatcgtcgcgtccctcgccacggtctgcgccacggcgattgcgctgctcgcggcgctggcgacgtaccgaccgttctacggacagaaaatggtcgagggtgggatcaacctgccgctgatcctgccggagatcgtcaccgctgtggcgaccttgctgctgttcatggcgttgggcatcaagctcggtttgctcacggtgatcgtcgcgcacatcggcttctgcattcccttcgcttacctgccgatccgtgcgcggctcaacgatctggacaaaagcctgctcgaagcggcgaacgatctgtacgccaatccttggcaagtattccgccgcgtgaccttgccgctgttgtggccggcggtgttgtccggtgcggtgctggcgttcgtggtcagcctcgacgacttcatcatgaccttcttcgtcgccggccccggttcgacgacgttgccggtgtacatcttctcggcgatcaaggccggcgttaccccggaaatcaatgcgatctcaacgctgatgctgctgatctcgattgtcctggtggtgctggccttctggttgggccaacgcggtaaacaacaataaatctggagcgctctgtttatgaaaagcaaaagcatgcgtctggcaatgtccggtctggccctgagttgtttcgccacgttcggcgcccacgccgccgaaccgaaagagctgtttttctacaactggaccgattactacccggtcgacttgctggccaaattcgaaaaagaaaccggcatcaaagtgaccatggacggttacgacagcaacgaaaccctgctcgccaaattgcaggccggcggcgccgcgtatgacgtgatcgtgccgtcgcaatcgatcatgcagacgctgatcaagcaggacttgctgatggaaatcgatgcgccgagcctgagcaacttccagtacgtcaaagggccgttccgcgatcccagtttcgatccggggcgcaagttctcggcgccgtatctgtggggcaccaccgggttttcctacgacagcgcgcgggtgccgggcggcaaactggatgactcgtggaaagagttctttgaaccgcgcaaagagctgcaaggccagctcgccgcactggatacgtcgagcagcgtgatcaacgccgccagccattatctgaacgttgatgagtgcagcgaaaacccgcaggacgccaagcgcatccttgaactgctgcaaaagcagaagccgtttttgaagatgtacagctccgacaacaccgtcgaccgcatggcttcgggcgaggtgatcatgatgcagaactggaacggttctacagcgcgggcgaccttgcagaagagcacgatcaagtacgtctatccgcgtgaaggcctggccatgttccaggacaacttcgccgtgccgaaaagcgcaccgcacccgggcaacgcgaagatttttatcgactggatgatgaagcctgagaacgccgccgccgtgtccaacgccattgcttacgccaacgggattcagagcgattcgttgctcgatccgaagtggaaggtgatggacgcgatcaacatgcctgaggaatacgcctcgcgtttgcgcccggaaaaggaatgcagcaacaaggcgcgggagctgcaggatcggatctggtcgaagctcaagggttgatcacctgatctgaaatcgaggtgcggccatcgctggcaagccagctcccacaggaatctgtgtcgcacatagaaagtgggcacacctcgacacctgtgggagctggcttgccagcgatgaggcccgcccagacaccattgaaccagaggtaaagaaatgacccagccacactggctccgcaacgtgcgcccctacggcgcccaagccgaagacctgctgatcgaaaacggccgattcgcccagcgccgcccggccagcaacacgccgctggccggcaccgacatcgacggccacaatcaactgctcaccagcgcgctggtcgaaagccacgtccacctcgacaaaaccctctacggccaaccctggcgcccaaacagcgccgggccgacgctcaaggactacatcagcaacgaacgccgcatcctccgtgaagtgaccgcacccatcgccgaacgcgcaggcgcgctgctggaaaactgcatcgctcgcggctcgctgaccatgcgctgccatgtcgatatcgacccggaattcggcttgcgtcacgtcgaggccatgcagcagttgcgcgaacgctacaaagacctcatcgacctgcaactggtggtgttcccgcaaaccggtttgatcagccgccccggtaccgccgaactgatgcgtgaagcgatggcattgggcgtcgaaaacgtcggtgggctcgacccgtgcggcattgacaacgacccgatcgcacaactggatttcatcttcaaactggcggctgagtttggccgaggcgtggacattcacctgcatgacaaaggtgagttgggcctgtggcagatcgcgctgatcgccgattacaccgagcgtttcagcctgcaaaaccgcgtgatgatcagccacgcctactgcctcggcatgctgccgtggagtcaggtcaaaccggttgccgagcggttggcggtgttggggatttcgctgatgagttcggcgccggccgacaccgccgtgccgccgtttctggcattgcatgagactggcgtgaatgtctgcctgggctctgacggcatccgcgatgcgtggtcgccgatgggcaatggcgacatgctcgaacgggcgatgctgctggcgtttcgctttgacctgggcaaggacgatgaactggcggcggcgttcgaggcggccacggttaacggtgcgcgggcgctgggcgtcgaggattacggctttgccctcgggcagcgtgctgacttcttgttgatgccggttgaaacccttggcgaagcggtggttgcgcggccattgcgtcaggtctatcgcggcggtgtcttgatcgccgaaggtggccgcttgctgagcagccgtctgtgaaacgcatcggtctgcgcgccagttgcgtggtcggtttcgacggcacgcagcatgtgctgtggcgcgacggcgaagtggtgttcgccgggtcgcacatcgagttcgtcgggcgtggttacgcggggccggtggatcagtggatcgactacggcaatgcgttgatcggccccggcttcatcgatctggatgcgctgggcgacctcgactccacggtgctgaccctggataacggcgacgagcgtgccatggggcgcatgtggtcgtcagactatctggccgctggcccgcgtgagacttacagcccggaagaagaagttttcaaataccgctacgccttcacccagctgatccgcaacggcatcaccacggcgctgccgatcacctcgatgtactaccgccagtgggcggaaacctacgacgagtttgccgccgtcgcaggcgttgccggcgaactgggtctgcgcacttacctcggcccctgctacatgagcggcatgagttactggcaggctgacggcaccctcgcccatcactgggatgaggatcgcgggctggccggcctggataccgctgaacgcttcttcaaggatttcgacggtgcgtacaacggtttgattcgcggtgcgctgctgccggatcgcatccagacctgcacgccggcattgctgcagcgcacctcggcgctgagccgcgaactgaacgcacccatgcgcctgcactgctgtcaggcgctcggcgaagtaacgatggttgagcagttgcgcggtgattcgccgttgagctggttacaacggctggacctgctcacaccgcgcagcctgttgccgcatggcatctacaccgctggcgatgacgacctgcaacgagtggtcgacggtggcacgagtctggtgcattgccctttggtgtttgcccgcgatggcgaggcgttgaactcgttcggacgctatcgcgccaagggcatcaacctggcgttgggcactgacacctggccggcggatctgctggaaaacatgcgtcacggcttgaacatcgcgcggttgatggagggcggcccagcgctgaccagcagcctcgatctgtacaacgccgcgaccctcggcggtgcgcgggcgctgggtcgcgatgacctcggacgcctggcccccggcgccaaagccgacattaccgtgttcagcctgcgcggtctgcatctggggccgttgttcgatcccctgaagaacctgttattggccgggcgcggcgacgactgcatcgccagttatatcgacggtcgttgcgtgatgcacgacggtcaggtcaacggcgtcgactaccccgccctgcaacgtcaggcgcaacgccaatacgaaaaactcatgcgcagccacagcgaccgggccgttggccgaccggactggaaaaccctgttccagccagccattccgttcgccgatgactacagcgccaaggcgccgttgagcgccatcgatccactttcctagaggtttttgccatgcacagttttgatttcagccaactcagcccacgggaaaaatacaagatcctgatcggcagcgtcgtgccccggcccattgcactggtcaccaccatcgatggcgagggccgagtcaatgccgcgccgttcagcttcttcaatgcgctgtcggcggacccgccgattctggccttgggcgtggaaaactacggcgatcagagcccgaaagacaccacgcgcaatatccagttgaaccaggaattcaccgtgaacatcgtcagcgatgcattggtggaggcgatgaacgtctgcgccgtgccgttcgcgccgggtttcgatgagttgaccgctgcggggctgacggcgattgccggtaccacggtgaaatgcccacggatcggcgaagcgccggtcgcgctggagtgccgacggatgatggcgctgaacatcggccagtcgcgggagatcatttttggtgaggtgttgatggcgcatgtgcgcgatgagttgatcgatccgaagacgctgtacatcgatcagttggggctggatgcgatcgggcgcatgggcggccatggctatgcgcgaacccgtgattacttcgatctgccgacccgctcgttgcaagcgtggacggaagcaccggggggtggcgagcggttttggcccgcgccgaaataaaccagaacaacgcattccccctgtaggagtgagcctgctcgcgatagcggtgtgtcagtcactttgatcttgtctgacacaccgctatcgcgagcaggctcactcctacaggggttctcagtggggcttgtaatcagtccgtgccgtacttcggcgaacgcgggccgtacagcagccccgccggatgcccggccgagagcaggcgattgctcgccacaccggcaatcggataaccggcatcagtggagctgttgatgatctgcttcaccgccgccgtgatcagcatgccgatcagaccgccaccaccgttgttgccaccctcttcgctcgacgcccgcgccgctccggtccacagcgtggtgccgcttttcaggtcaaccagtttcgctgtcgcggtcacagccgtttcgctgctgatcaccatgtaacgcgtgccgtattcgctcacggtgatgtacagcgccgcatccgcaccgaagatttcctgcagcttgtgcggcggtgcctgatgaatgtcatccggcgtggtcaggccgttctggcggaaggtttcgtccaccagcgcgatcggcaacacgtaataaccggcttcggccagcgggaacgtcacttgcgacagcaggctgtacgacgccttcacgtccggtgaggtgttcagcggtggcaacaccagaatggtcttgggccgtgcctgtttgtacgccgagtagtccacggtcttcggcgcgacacagccgccaagcagcgtcagggccagcgcaccggccagcagtttcaaggtgcgcgagatcattgcacgactccggccttggcgtttttaagcagaaaatccatgtacgtgccggactcggggaacagggttttctcggtgttgaactgctgcaccatctgatcgtccttgcccatgctcaggtagagcaggcccaagtgcgcgtggtagcccggtggtacggctttgccggtggagcggatcttttgcagatcgcgttccagtgcttcgacctgcgcctctttcggctcttcgcctttgaagtattcgtagacctggggctcgtagccttcccactggtacagggtttgcgggctgctgcaaccggccagcaaggcgctggctgccagcgtcagcgccatcagcgagcgcgacaaagtcagattcatgggtattgctccttgcaatgggcgtcgatcagttgcccggtttccaggcaccggcgttcatgccatcgaccagacgattgatcgcctcgcgcatggccagatcgaggactttgccgttgagggtcgaatcgtaggcagcggtgccgccgaagccgatgatttcgcggttggacaaggcgtattcgccagcgccctgggtcgaataaaccacttcggaggtgctgatgttgacgatgttcaggttgaccttggcgtaagcgacctgagtcttgccgcggccgagaatgccgaacaattggtgatcgccagtctctttgcgaccgaactcggtgacgtcaccggtgaccacgtaatcagcacctttgaggcgctgggcctggcctttgatcgccgcttcctgctggatttcgcccatgttgtcgcgatccagcacgctgaagcggttggtctgctgcaagtgagtgatcaggatggtcttggcctggccgccgaggcggtcgacaccgtcggagaagatcccgcgcatgtagctggagcggttgtcgaacttgcccaccgccattggcacgcgaacgccggtccagatctgcgaagcgctttcaaccttggccaccggcagcgcgcgggagctttccgtggcgcaaccggagagtgtggtggcaagggtgccaagcacggcaattgccacgcctgaaaccagcatccgggagatcattctcactgggtaatccttttgaaaaacgggggtgtcccggcacggcaatgcggtacaggggctgaaaagggccggcattatgacaaagtgccatcattgcgaacagatatttttgacgccaatgaattggcttgggttggccgttgatcgttcccacgctctgcgtgggaatgcagccacggacgctccgcgtccgctgtgacgcggagcgtcacgggaggcgttaccacgcagagcgtgggaacgatcagacaaggggtcggtgcgctaatggaaatcgcgactctgcacgcggatgccgttgagcaatgggctgaggtcgctcaagcggccggcgatcagatggcgcacgtcgccttcgcgctcccagcggccatcgaccctgagcaattgcgaaccgaccagcacttgccgttggcgctcggccaggtcgcgccagaccactacgttgacgttgccgaactcatcttccagcgtcacaaacgtcacgccgctggcagtccccggtcgttggcgcccggtgaccagcccggcaatgctcaccggcctgccatgctcaacgtcgagcaactcctgcgaactgcggcagcggcgcgccttcaactcgccgcgcaacagcgccagtggatgcggccccagtgtggtgcccaccgtagcgtaatcggcgtgcaggtcctcgccgacgctgggttttggcagcaccacgtcgggttcttcctggctgggcaacccggcaaataatccgagctgcttctgcaccccggccacctcccaccgcgcccgatgtcggtgcccggccaaaccgcgcagcgctccggagtccgccaacagcgcctgcgcccggctgtccagcgcggcgcgttcaccaagatcggcgacatcggcaaacgccccacgcgagcgcgccgcttcgatgcgccgggcgtcctcctcgcgaaagcccttgatcatccgcaagcccatgcgaatcgccggttgcgccgccgtggtggtttccaggctgcaatcccagtcactggcacgcacgtctaccgggcgaatctgcaattgatgccgacgtgcgtcctggagaatctgatccgggctgtagaaacccatcggccagctattgatcaacgcgcaagcgaacgccgccggttcgtggcacttgagccagcaactggcgtacgtcagcaaggcaaaactggcagcgtgggattcggggaagccgtagctgccgaagcctttgatctgctcgaaaatctgcgcggcgaactccggtgtgtagccgtttttcttcatcccggcggcgaggcgttccttgtgcggctccaatccaccgtggcgtttccacgcggccatcgagcggcgcagttgatcggcctcgccggggctgtagtcggcggcgacgatggcgatctgcatcacctgttcctgaaacagcggtacgccgagagtgcgtttgagcaccacttccagctccggcgacgggtaggtttccttttcttctttatttcgacgccgcaaatacggatgcaccatcccgccctgaatcggccccgggcggacgatggccacctcaatcaccaggtcatagaacttcgccggtttcaggcgcggcaacatcgacatctgcgcccgcgactcgatctgaaacacgccgacggtgtcggcgcggctgatcatctcgtaagtcggtttgtcctcggccggaatcgtcgccagactcaagtccagattccgatgtcggcgcagcaggtcgaagcaacggcggatcgcgctgagcatgccgagggcaaggatatccaccttgagcaggccgaccgcgtcgaggtcgtccttgtcccattgaatgatcgtgcgctcggccatggccgcgttctcgaccggtaccagcgtgtccagcggctgttcggaaatcacgaaaccaccagggtgttgcgacaggtgtcgggggaagccgatcagttgcccggtcaggctcagtacgcggcgcagcaccgggctttcgggatcgaagcctccctcgagcaagcgttccagcggcggtgtttcatcgctccagtggccgcagcaatcggccagtgcgttgatttgatccggcggcagccccaaggccttggccacgtcgcgtacggcgccggcggcgtggtaagtactgaccactgcggtcagcgccgcgcgaccacggccgtaacggcgaaacacgtattgcaggacttcttcgcgacgttcgtgttcgaagtcgacgtcgatgtccggcggttcgttgcgctccttggacatgaagcgttcgaacagcaacgtggtgcggtccgggtcgatttcggtaatgcccaaggcaaaacacaccgccgagttggccgccgagccacgcccctgacagagaatctgctgctcgcgggcgaagcgcaccacgtcgtgcacagtgagaaagtagctttcataaccgagctcggcgatcagctgcagttcatcgtcgatctgcttgagaaccttggcttgcgggcctttgggccagcgccaggcaatgccttcttcggtcagatggcgcagccaggaactggcgctatatccctcgggcaccagttccttgggatattgataccgcaattcgcccagatcgaaagtacagcgccgcgccagattcaccgattcgtcgagcaatgcctgcggatacaactcgcgcaacacctcgacactgcgcaaatgtcgctcgccattggggtgcaggcgcaacccggcctcggccaccggcacgtgatggcggatcgcggtcatggtgtcctgcaaggcgcgtcggcctcgggcgtgcatgtgcacatcgccgctggccacggccggaatctgcaactcggcggccagactcaacaaccttgccaagcgctgctgatcgtcctggccgcgatgcaactgcaccgccagccacaggcgctcgccgaagatctgtttcagccaacggccctcttccacctgctcaagcgaatccggcacccacaacaccagcagccccggttgcggctcgctgaaatcttcgcgcagcacctgatactggcctttctgcgtgcgtcgtcgggcgcgggtgatcaagccgcacaaggcctgataaccggcgaggttctccaccagcagcaccagtttcgggccgttttcgatgcgcacttcactgccgatgatcagcggcagctcaagcgatttcgccgcttgccacgcccgcacaatcccggccagcgtgcattcatcggtgatcgccagcgcctgatagccatgctttttcgcccgctggaacagttccagcgcactggaggcaccgcgctggaaactgaagttcgacaggcagtgcagttcggcataaccgtcgttcatgcaaaccagccctgcagccacaacggaccgccctcacccaccgcgcgataagcccaaccctgttggccggcgcggttctggatcaggtaataatcgcggcgcacatcgtcgccgtcccaccagcccgactcgatgcgttccgggcccatgagaatccgcgccgaaccttgcggcacgctctgcggttcatcgagcaaccagcccggacggtgcacgcccggcaacgcagtgcagcgctgtttgtcgacgccgttctgccatgcgcactcgggccgatgatcggcctgaaaacgcagcccctgcaccgcgtcatcgcccaagcgtgcacgcaagcgttcgcgcaactgctgccacggcaaggtttgctgcggacggtcgtcgaacagctcctgaaactgcgggacgaagctcggcaggtcctcggcgcgcagacgaaagccgcgcacgggtgcctcgacctgcacttgctccagccgcccacgggccagttcgaacagcatcgccggatcacgttcggcgctgagcaggccaaccttgattacgctgtccggcaacccggcgtgctccagatgcagatcgaaacgctgcacgccgctgtcacgcccgcagaggaacgccgacagatcgccggtcaaacggcgtaacgggaacagcaacgcctgatgcgattgcacgtcgaaattcagctcgatgcgcacatcgaaacgatccggcggcaggtaaaacgccagcgccaacgggcgcgcgccgaacagggtgtcgaggtgcttgagcatcggcgcttcgaaacgtcgggccagtgcctgacggggcaagctctgcacctgactgagattacgcaggcccatacgcgacaacgctgtagccacactcggttccaggccgacgcggtcgacaggcaactggccaaggtgatgctgcaaggcttcgccgtcgggcaccaccaatccatcgtaagcattggccagcacccgcgccgccactggattcggcgcggcgacgatgcgatgacgaaagcccaagtccgtcagttccttgcgcaggcgcgcttcgaactgcgcccaggaaccgaacaggcccaggctggattcgatctcgaacaccacggtgcgcgggtaatgcacgctgacctgcgcgctgaaaccgtaggcccatgcggccaaaaactgctgccagtgctcgacctcggcagcctcgtaatcagcggtggcaaaccccttgctcatggcctgggcggcagtcatcgactggccggcgcgcagaccgagtttgcgcgcggcaggattgaccgcttgcagcacccggcgctgggccgggccgctgagcagcaccaacggctcatcgggatcgggacgctgacgcagcaccgcgtccagcgccaattgcgggaatagaatgcagacccagcgcatggcgacctcaatgacccacggcaaaggcaatcggcgccgtacgcgcgagtccgccacggcacttgaggacgcgcaactgtgcaggtttggcgtcgatggcgatgcgcaacgccgccggtgacgggttgaccgcttcgctcaacgggcgccaggcaaatgccagggtctgaccggtttccgccgccacctgcaaacgccgcaacgcacggtcatcggccttgtgcggccagcacagtacggcgccgcaactgcccgaacgcaggcactgttccgccgcccacaaggcatcgcgctcagaggcctgaatcaccgacaactggcgcagatcgaccccggcgttttcccacgcttgcgggtacggcacgaacggcggcgccaccagcacaatgcgctcacccgccgccgccaaccgcgccagcgttggccagaccagttgcagctcgccaacaccggggccggccaagaggatttcgctcagcgccgcttccggccagccaccgctgggcagtgccgcgtccagcgccgcatgcccggtcggctgcgggctggcagccggtggcgcaggccggcccttccagacctggccgccattgaacagcgtatccaacgcaacgacggcgcccatcagccttgcctcaccagaccgcagaacaccccttcgatggccaggtcctgatcgtcgcgcacgacaatcggctggtacgccgggttgcgcggcaacagccgcacttcatcgccgagccgttcgaagcgtttgatggtgacttcaccgtcgagccgcgccacgacgatctggccgttgagcgcctcgggattgcgtcgcacaccgaccagatcgccgtcgagaatgccgtcctcgatcatcgaatcgccctgcacccgcagcatgtaatcgggtgtgcgcgagaacagtgccgggtcgagcagcaagcggctatggatgtcggcatcggcaccaatcggcgcaccggctgcgacgcggccgagcacaggaatgtcgagcagttccgggcgcggcggttgcccgagcaaacgaatgccccgggcctgattggggttgacctcgataaaaccggcttcggtcagcgcgagcacgtgcttgcgcgccacgctgcgcgaggcaaaaccaaaagcctcgctgatttcagcgaggcttgggggctgaccgtgttcggcgatgcgatcgcggatgaaggtcaggatggcggtacggcggggagtcaggttcgtcatggagtacatttgtactcttttggctttttcctgacaagcgccgccagtcggcccaccccacgttgatcgttcccacgctctgcgtgggaacgatcagcgcgggggtgttagccaaggccacgttcggctaggaattcggcgatgtaatcgatgaaggcgacaaccttggccgtggcccgacgatgactcgggtacaccgctagaatgtgcgggccaaaggtatccggatcgatctcgtattcggccatgacccgcaccaatcgcccgtcggcaatgtacggcgcggcgctccacaacggcgtgtgcagcaaaccgcgcccggccagagcactggccagcaacaaatcataattatcgctgcgcaacagcggcgccgtcggttgcgccaggctcaagcgctgcccgtcgcgctcggcccaccagaattcgcggctgagcaacggatgctgatagagcagccattcatgctgttcaagggtctgcggattgaccggcaagcccttgcgcgccagatactccgggctgccacacagggccaggcgattgctgcccaccacccgcgcaatcaaccccggcaaatcatcgtggccttcgcgcaacgccaggtcgtagccactttccagcagattgacgaacgcgtcacacagatccacttgcaggctgatctgcgggtattgctgcagaaagccgtcacacacctgatcgagaaacgcccgcccatacgccagcggcgcggtgattttcaggctgccgcgcaaaccgtgctgcaactgttcgatttcctcgctggcctcatcgagccgctgcaacaccagccgcgcggtttccaggtacacccggccgatttcggtgagcaaaatccgccgcgtgctgcgctcgaacagccgtgcgcccagctccgcttccaggtgattgaccgctttggtcagcgccgacggggtcttgcccaactgctcggcggcgcggctgaaactgccgagctgcgcggtgaccacgaacattttcaatgcacccaacttgtccatgctttttccattcaggcaaaaacgtttttcgtgcgggaggcgttctgtcagacgctaccagccactaatctcgccatcagacgcaataacaaggaaatcttcaatgaaaagattcatcccgagtctgttggcagccgctgtaagttttgcctcgatggaagccatggccgccgccgatctggtgctgctcaacggcaagattttcaccgccgaccgcgcgcaacccaaggtgcaagcactggccgtagagaacggcaaagtgctgaaagtcggcagcgacgcgcagatcaaagccttgatcgaacccgccacaaaagtcatcgacctcaagggcaaagcgctgatgcccggcctgatcgacagccattcccacgcgattttcggcggtctggaaatggtctcggcgaacatggaggacgaagtcgtcaacctcgacgaactgcaaaaacgcctgcgcgactggcgtgaagacggcaaggccaaacatggcgacgtgctgagcattgccgggatgagttcggtttattgggcgcaagccgaagccttgggcaacaccttcaatagcggcgaatgggccaatgtgccggtggtgtttatcggcagcgaccaccacacggcgtgggccaacaatgtgatgctcaagcgtgccgggattgacgcggccctgctgaaaaccctgccggatgcggaaaaagacaccatcggcaaactggccaatggcgagccgaacggttttgtggtcgacgccggatgggatcgggtcgcctcgaaaatgccggtgccgagccccgccgacatgttgaacgccgccaaatccgcagtgcgctacaacaacagcctcggcatcaccgcctggatggacccggccgccaacgccgcaccgggcgaagcagtgttcgcgctcaaaccgaccgagaaaaccgtcggcgtgctgccggcctataaagcgctgtcgcaaagcggcgcaatgagcgtgcacgtcgccgcgttgctggtggccaacccgaaaagcgtgcccgccgacctcgatacgctggacaaggtgcgccagcaatttcagggcatcccgaatctgacgttacccgggatcaagatcttcgccgacggcgtgattgaattcccggcgcagagcgcggcgatgatcgatccgtacagcaactcgcacaaacagggcgaactgctgatcgatccgcagcatttcggcgaactggtcagcgccatcgatcagcgcggctggctggtgcatatccatgcgatcggcgaccgcgccgtgcgtgagtcgctgaacggcatcgctcaggcgcgcaaggatcgacagagcggcgtgacccactcgatcactcacctgcaaatggtcaatccgaaagagttcgcccgcttcaaaccgctcaatgtcatcgcctcaatgcaactgctgtgggccagtgccgatgactacaccaccgacatgatcaagccctacgtcagcgccctcgcctttcgctatcagtacccggcgcattcgctgctcaaacagggcgcgacgattgccggcgcgagtgactggccggtgtcgacgccgaatccgttcaatgccatggcgcaggcgatcacccgcgtcggcccgttgggcgtgctcaatgccgatgaacgtctggatcgcgaaacgatgttctacgcctacaccgtcaacgcggcacgaacgattggcctggagcagcagattggctcgctgacgccgggcaagcaggctgattttatcgtcctcgaccgcgacgtgttcagcgtcgacaacaaggccctgcatgacacccaggttttgcaaacctggttcggcggtcgtcaggtctacaccgccgcaaaataacaacactgttcccctgtgggagcgagcctgctcgcgaaggcggcgtatcagtcgccatcaatgctgaatgaaccaccgctttcgcgagcaggctcgctcccacagggtctgtgagggtggtcgaaatcgaatccccccgcagttctctttctgcccaaaaataatcacaacatcgggacttcacatgaaagccttgcccctgttcgccctgagtttgttgagcgcgctgccgttgagcagttttgcgctccccttgaacgatgactttgcgctgttggtcgacctgaccctggccagcgattaccgcactcgcggcatctcgcaaacccagaacgacccggcggtgcaggccggtctgaccctcgctcacagcagcggcctgtacctcggcgcgtggagctcgaatgtcgatttcggcggcgggctgaaaacccgtcaggaagtcgattactacggcggctggctgtggcagacgaccgaggatgtcagcctcgatctgggttacatcaagtacgcctaccccaaggaaagccagttcaaccagagcgaggtttacgggattctcggggtttacggggtgaaactggcggcgtattactccagcgatgcaccggggatcgatagcaaacagagttcgctgtacagctacatcggttatgaaaccgagttgccatttgattcaggtctgaagctgcgttacggcaatatggatttcaaggatgcgcatttgtactcggcgtcgggcagcgctgaagactcgtaccgcgaatgggaggtcaaactcacccacaatctggccggggtggtgctggggttgagctacatcgataccgatctttcacaaacccaatgtctgagcaattggggtttcaaagacgtctgcactgccaccgtcgtcgccagcctcagcaaatccttctgacccaccgaaatccccctgtaggccttcgcctgctcgcgatagcggtggataaggcaacatcattgttgaatgacacaccgctatcgcgagcaggctcactcctacaggagattgtggtgtatcaggaattgaggtttgccagataggcccacgggtagatgccgcgctggtggccgtcgctgaacaccagttgcacgccgtagccctggggattgagttcgatcaggcgcacgcggtcatcgaccagcggcgtcaggcccttgaggcgaaacgcgcggcattgcgagcacgggcactggcggcgcagctcggcgtggttaagttgttgttcgtgcccgtcaggccaagtcagccgaagggtttgctcgctttgcgagttaccgactgacagcgggttcattgcaactgactcagggcaatgcgcacggctttgcgcacttccgggtcgccgtcgtcctgtgcggcctgcaaggccgccacggcgccgcgatcattcaactcacccaaggccagtgcggcctcttttcgcaggttgctgatgcgatggccgagggtgtcgatcagggcgtccagcgccggggcaaattgcaaacggccgaggctgcgggtggcgcgcaggcgtacttgccagtagtcatcgctcagcgcttcgaccagcgccgggccggcgtcgcggtggccgactttgcccagtgtcgttgcggcttcttcgcgcacttgccaggcgttgtcctgcaaggcctggcgtagggccgggaggacttcagcgctggaggccagccccaaagcgccggtagcagcccggcggacttcggtgtccgggtcggcgctggccaatcgggccagggcgggcaacgcgtcgagctgcttgagccagccgagcacgccgacggcttcgcggcgcacgttggcatcggcatcgttcagtgcagagaccgcagcaggtgcagcatcggcgaaacgcagttcacgcaaggcgcggaacgccgcgatacgcacgctgacgtcggcatgatcggtccacggcagaatcacccgccccgctgcttcagtcttgagcagactcaagctctgcgcagcagcggattgcacggcgggcgacgagtcggtcagcgcctcgcacaaggcttgcacaacgtcttcatcctcccaggcttccagcaaacgcgcggcttcagcgcggacgtcttcggcaggatcctggccgaggcgatcgaccagccagagcaagccatcgggctcctccagatccgccagatcaatcagcgcaatacgccgcacgccagcatcttcagcagtcagacgcggttgcagggcgaggatttcatcgttatcggtcacagcaaaaatagaggtcatagggcaaatcgcggcaaagggttttcgggaggcaggccaagcggattaaggcgcggcagcggtcggtcgttgtcgtggcgcaacaggtcgaggcagtggcgcttgaggcgggagaattcaggactggtcaccagttcactggtgcgcggtcgggtaaagtcgaggcgtaaatcttcgatgatccgccccggtcgcgcgctcatcaccagcaagcggtcagcgaggaacagcgcctcgtcgatgtcgtgagtgacgaacaccacggtggtgcggatgcgcgtccagatgtccagcagcagttcctgcatgttcaaacgggtcagcgcatccagcgcgccgaatggctcgtccatcagtaacaggcgcgggcgattgaccagcacacgggcgatttcgacgcgttgctgcatgccgccggagagttgatcaggccagcgttcggcgaaaccttcgaggccgaccagtttgaggatgtcgtcggcagcacgatgacgctcggctttgccgatgccacgcatcttcaggccgaaagcgacgttgtcgcgcaccgtgcgccacggaaacagcgtgtgatgctggaacaccatgccgcgctgcggcgacgggccggacactgccgcgccatcgactttcaggctgccggcgtgcgcattcagatgcccggccaaagcgccgagcaaggtcgatttgccgcaaccggaggggccgagaatgcacacgaactggcccgactcgatctggcaatcgagttctcgcaccgcttcgaacgcttcacttccttggccgaggacgatggacaattggcggatgtcgatccgcccttccggagtttgcatcgcgctcatcaggcttttcctcgcggtcgatgccagggcgtgaacaacccgcccagacgtttgatcagcagactgctgcccatgcccaacaccccgatcaggagcatgccgacgacgatgtcggcgtagttctgaatggtgtaggactcccaggtgtaatagccgatgccgaactggccggagatcatttctgcagtcaccagacagaaccaagaagtacccatgccgatcgccagaccggtgatgatgctcggcgcggcgccgggcaaaatcacttccagcagaatcgcgcggcgccctgccccgaggctttttgccgaggcgatcaggcgtggatcgacaccttcgacgccgtgcacggtgttgagcaggatcgggaacagtgcaccggtgaaggtgatgaagaccatcgacagttccgaggacggaaacatcaggatcgccaacgggatccacgcaacggcggggattgggcgcaggacttccagcggtggcagcagcaggtcttcggcccattttgagcggccgatggcgaggcccaaggcgatgccgatgacgagcgcagtgagatagccggcgaagacgcggctgaggctggcggtgaggtgttgcaggagcttgccggagtcgccgaggcccagcgctgcttctaccacggccaaaggggttggcacgttggcaaaggtgatgaggccgaggttccagtgatggctggcggcgagctgccagaacagcaggcagagcagcagtgaggcggctcttgatgtccagcgtagggtgggttttttcatggagcgggtttccggttgtggagctgtgtgatggctgagaactaccccctcaccccagccctctcccccaagggggcgagggggaaagggagccgatcttcacgtttttcaaaacctgagttcggctcgagaaggagccgatcttcatgcctttcaagcctgagttcgactcggtatttcaggtcggcgtagctagtccaaacaccgcggtcagtcccctctccctttgggagagggctagggtgaggggcttttgatcttcaatcagcgagtagcaaccgcttgggtcgtggcatccgtaaagtcgaaaaccttgccaccctgcgccgaggcaaattgctgagcctgccccttgagcaaaaacgcactcaaccgtcccttcgcatcactggcaaaccacgcctgctcagccagcaacttgatcccgctgtcactggcctgcgcataaaccgcacggacgtttttgccttcctgcttcaacgccgccagcgccgtgaacgcctcttgcgccgaggcgtattggcgcaccttgtcctcgccacgcacccagatctccgcaacatgactgaagtcagtaatagctttaccggtcgccgcatccgtcgcctgcaacggcgtctgcgcgtagttcgccagttgcgccgtgtaatccaggttcgacgccttgaacgccgcacggatgtattggtcgtcaatgaagttgttcagatcgagcccgcgatcagccttcttcagcagcttcaacgtatcaatcgcggtgcccaccgcctggcgatattccggcttccagctcaggtcgcgggtctgtacgccgagcgggccgtggaacaggtagttcacctcagcatcgacgccggtcactttggcgatcagctcgctgtatttctccggctccgccgccagcaactgattggcctcgatactcgcgcgcaggtaagcgacgacgacttccgggtacttcttcgcatacgcctgatccaccagcgcaccgtggaacgtcggcgcattcgcctgagcaccgtcataaatcttgcgggcgaaaccccggctcgggaacagttcggcgaacggcacaaaatcggcgtgggcgtcgatcttgccggcctgcaacgccgagccggcgacttccggcggctgggcgatgatgttgacatccttgagcggatcccagccctgcgccgccacggcacgcagcagcatgccgtgggcggtggaggcgaacggcacggaaatcgtcttgcctttgagttcgctgagtgactgcacgcccgaagcgctcggcacgacaataccgttgccgctgcccttgatgctgcccgacagcacgctgataaacaggctgtgcttgccggcggtttcaaacgcgacgccgttgaacgcgccggggaaatcagccatggcaccgaagtcgagtttgccggcgaccatctcgttggtcagcggtgcgccgctggtgaagttcttccactgcacgtcgtacttcgcgtctttgtaggggccgtcgtggggcaggtatttgtcgagcaggcccagttcacgaatcaacaagccgccagcggcgcaattgatggtggtgtcctgggtgccgatggcgatgcggatggtttcggccgaggccgacaaagtgaacgaagccagtaccagaccggcgattgctgcacgcaacatggttgtttcccctcgaatcatttatttgagttcgtctccgccgcgatcagggcgcggtgggaaacgaggggttttcggtgaatccagcgtccggggttcaccggatggctttgggttgtcacagttcaaatgtaggagtgagcctgctcgcgatagcggttttccagatgttgatgtgctgactgacacactgctatcgcgagcaggctcactcctacagaggatcgcgtttcaacgcaggagataggggatctcgaccttgacggcgcccgtcgggcaatccttctcgcacggcatgcagtaccagcattcgtcgaacgccatgtaggccttctgcgttgccggattgatcgccagcaagtccatcgggcagacatccacgcacacggtgcagcccttttcggcgatgcatttgtcctcgtccacggtgacgggggcgttggagcgaaagaagatttcctgagcttgataggccatggttcggactctcttttagtagtgcatcaagcggcgaaagcgccgacccgcaagcggtcgtaggcctgcatttcttcagcatcgagcggaatgatgtaaggttcgacggctttcttgaaactggtcatctggccgtcgtcgcccttcttcaaatggcaatggcagaaccattcgctatcgttgcgctgcgggtggtcgacgcgatagtggtacaaaccccagcggctttcggcgcggaacaacgaggcgcgggcggccatttcggcgcagtcgcggatcacgctggtttccatggcgcgcatcagttcatgggcgttgttggctttcatctgatcgagatcgcgttcgatgtcgctgaagcgctgtagaccgatctgcatctttttggtcactttcggcggctgcaggtaatcgttgacgaagcgccgcagcttgtactcgacctgtgctggcggcagaccgtgttcgcgatccagcggtgcgtaaacccgggccttttccttctcgatctgctcggcatccagcgcggaaaactcgcgaccggcgacaaaatcggcggcgttgtgcccggcaaaccagccgtaggtgaaggcgccgagcatatagttgtgcggcacggcagccatgtcacccgccgaatacaagcctttcaccgaagtctcggcgcgttcgttgacccacacgccagacgccgagtggccgctgcaaaaaccgatttcggagatgtgcatttcgaccatctgcgtgcggtagtcagtgccgcgattggcgtgaaactggccgcgactcggacgctcgttgctgtgcagaatctcctcgatgttctggatggtttcttcggccaggtgatcgagtttgaggaacaccgggccgttgccgctctccagttcctggtggaactcccacatcatctgcccgctccagtagtcgcactcgatgaagcgttcgcccttgttgttcgcggtgtagccgcccagcgggccggtgacgtaagcgcaggccgggccgttgtaatccttgatcagcgggttgatctggaagcactcgaggttggccagttcggcgccggcgtgataggccatcgcgtagccgtcgccggcgttggtcgggttttcgtaggtgcccatcaggtagcccgacgacggcaaacccaggcgtccggcagcaccgcaggcgaggatcaccgctttggccttgatcacatggaagtcggcggtgcggcaatcgaagcccatcacaccgttgacggcgccctcctcgtcagtcagcaaccgcgtgcagacgaggcgattggtgatgctcacccgggcgcgtttcaactggcgataaaggacctttttgatgtcgtgcccttccggcatcggcagcacgtaggcgcccatgtggtggacttttttaaccgcgtaatcgccggtttcgtccttctcgaacttcacgccccagcgatcaagctgttcgatggtttcaaagctgtgagtggcgtaagcgtaaacggcggcctgattgacgatgccgtcgttggcgatggtgatttccttggtgtactgctcaggcgtcgagtggccgggaatgatcgcgttgttcagaccgtccatgcccatgctgatcgcgccgctgcgtttgacgttggccttgtcgaccagcaacacgcgcagatcacggttgttttctttggccttgatcgcggccatcggcccggcagtgccgccgccgatgacgacgatgtcgtattcctgttcaagcacgttgcgggtcatgcctgctcccctttttgccggtcgatccgcaggcggtactggaacgcatcgccacggtagtaaaggtattcgaagtccagcggctggccttgcgcgtcgtgggtcagacgctcgatgcgcatgatcggcgagccggcctcgacgttcagcgcctgggtcaagtcgctgtcggcgagcaccgcgtcgatggccagatcggcgtggccgagggcgatgccgcagtcattttcgaggatcaggaagatgtcgcgggtgaccagatcagccttctccaggcgctcgccgacggctttgggcaggtaggtgatttccagcgagatcggctcacggttgatcaggcgcacgcgtttgatttgcgtgacgatctcgccctcggcgacctgcaaacgttcggcgacgcgcttgtcggcggggatgaatttgaagctgcgcaggcgattgatcacctcgtagccacggccggtcatcgactcggctaggccttgcaggctgctgacgttctgaaaggttttcggcttggcgacgaaggtgcctttgccgtggatcttgaagatcagcccttccttttgcagatcgccgagcgcctggcgcacggtgatgcggctgactttgaacagcgcaccgagttcgctttcggaaggcatctggctgtcttgcgggtattcgccgtcgagaattcgcgcacgcaggacatcgcgcagttgggtgtgcagcggaacgctactgagggagagaacgttatcggtcatcacgggatcacttgttataacgagttatgacgtgatcttagggttgttatgacgaggttgagaaatattgtttgggcataaccttagatacttcacacgatcgcttcttgtaggagtgagcctgctcgcgatagcggtgtatcagatacgaatccggtgcgtgacacaccgctatcgcgagcaggcgaaggcctacaggggaattgtgtgctactggcgtttgaggatctggtccatgacccagtcggtcttgagcgcttgttcggcgacggcgggatgttgtgaatcaccacgaatatgcgcattcatgcccaatacgtgatgccactgaatgtgttcgtgatgcgggatttccaggctgatactttcatcggcatgcaactgcacgggatgctcatcaaacaccgaaaaactgatccgcccttcactgccgatgatctcgacgcgatcttcgcgccgatccgcaacaaaactccagcaacccatacccaacgccccggaggcaaaccgccaactggcgctgacggcatcttccgctgcatataagccggcctgacgcgcggtgaatccggcgacttcaacaatgtcgccgagcagatactggaacaggtcaaaaccatgactggccagatcagcgaagtaaccgcccccggccaccgccggatcggtgcgccagttatcgcgaccgtccagatccgccggcgacggcgctttggtcaacgtccagctcaggtgccgaacctcaccaatgcgcccctcctgcaaccattgccgcacttgcgcaaagcgcggcaacgagcggcggtagtaggacacaaacaagtgcaatccggcctcggcaaacacctgctgcatctcgcggctttgtccggcattcagcgccatcggtttttcgacgcagcaatgcttgccagcggcagcgactttcaggctgtaggcgtgatggctgtcgggcggcgtggcgatgtacaccgcgtcgacctcgggatcgttgatcagcgcatcgacgtcggtgtagacgcggtcgatgccatgacgcaaagcgtaatcgctgaccgcttcaagccgtcggcccatcaccgccaccagcgccgaaccgggcgccttgtaaaaggccggcccgctcttgcgttcagcgacgctgccacaaccgatcatgccccagcgcaccacgtccatgtctgttcctttagccgatgcgcaacgcgcgcagatcgaggtgaccgtccttgagcggcgggcaccagtagtagccgccggtgatcggtcggctgatgcgatacaagccatcggtgatgccgtcttccaggccgctcatacggcgcagttgcgcttcgaaggcgtccagcgagcaaccgaaagcgaggaacatcaaaccagcgcgatcaccttcgatccacggcatcgagcggcgcacgacgaacgcttccggggcaaagctttcctgcgcggtgcgtttgacgtgggcggagactggcgcgtcgtcgatctcttcgttgtcgctgaggcgacggcccatgatgttgtctttgtcgtcggcggacagtttgtggaaacccttgaggtcatgctgccactgctggatcgcggcaaagctgccaccgaccatgccgtcagtgccggcgctttgcagggcggcggtgatggcggcttcgtcgtgcgggttttcggtgccgtcttcgtaaccggtcaggtcgtggccgtccttgtggcggaaggcttcctgcatttctaccaggcgcagggccggggccagtgcggcttcgagggcgttgcaacggttgagcagttcaccacggtcgacgccgtgcagccagacccacagtgcgtgctgggtcgacgggttctcgacgccgacgccggtcatggccgggaagctgcgcaggccttcaatttgtacgttgagggccttcgccagggattcaccgaaaccgaccaccgccgacttgccgtccacctgattcagcagattgtcgatcgcttgcggcagggcttcagccgattcaagggcgaaaaacaggtgacgtgcttgcgcaggaactggggtggcgagaatgcccggctggtagtaactcatgtgaactccttgggaaagtgcgcgggagtttacctgtggccggagggtttgtgtgggtttggatggaagtcaaaagcccctcaccctagccctctcccggggggagaggggactgaatgggggatattgaagagctacgccgacttgaacgtgtatcggtgaatccataatcgacaaaaatctttcaggtcgatgtacgacgaaagacactgcggtcggccccctctctcaagtccataatcgacgcaattcttcaggtcgatgtaactcgcaagacactgcagtcggccccctctccctctgggagagggctggggtgagggtttgcgtcattgcgccaggcactcgggctcaaccctgtccagcgcttgaacgcccggcgaaaactgcgcacatcgctgtagcccacttcctcggtaatccgctcaatcggcatatccggattggccagcaaactcatcgtccgcgcctgtcgcacctgctccagcagcgcctcgaacgtcagcgcatgctcagtcaaacgccggcgcaaggtgcggctgctcatgttcaagtcaccggcaatcttttcgatatggctgccagaggtcaaatccctggcaatcgcccgctcgaccgcctgaatcagatcaagcttctgatgcacctgcgccgcttccagctccagcaaggcgaccgcctgacgcagcgccagcgaatggtgattgggcaggttcacgtcaagccactgcgcatcgatcagcatgcggttgtgcagacaaccgaagcgcacgtccggcccgagcaggcggtggtattcgctgaggtaatccggtgcggcatgcacgaactccacggcaatcgccttgaaatcaacccccaccagtgcgcggccatacaccagcagactggcgaagaactcctcgacggcaaacacctgcacatcggcgaatggcaggcggcattcagcatccagatgcacctgcgcaccgaccacgtcgacgctcgacaccacaatcccgcccgaggtgtgctggtggcgaatccccagcgcaaaggcgtcgcgcagggttttgcacaacgacagcacatgcccgagcaacccgagtgtgccgagtacattctgtgcgcccacccataggcccaggccctgatggggcagcactttgagcgcacgttgaatcatcgccacggcctggcgataggaaatccgctgcgtcggatcctgtaagtcttccagcgtaaaacccaggccacggcacaggctttcgggatcgatgcccttgttctgcacgacttcggcaagggtttgcaggagaaacggcgagaccagcgccagttcgaaagtcgggtcttggacttttacattcatgggggatgacattccggatcacgcttgattgttatttttgttaccggttatgtcgaaggaagttagcacagggtttgccagctgtccgcagaagtccccctcagtgtccgccaaaaccctgccccgccgggcgccaagcgcttatttctagagtgccgcgcgcactgcgtgccggcgttgcgcccaaaacacaataataatgaggacggatatgcacccgaaccgcgcgacattccctctgcgcctggccctttccttgctgggttgcgccgtgacgataccggcactggccaccgaagccggcgtcgacaacatcggcaccggcaccgacggttttttcatgctgccgctggaggtcgacagccttccggagaacatggtcgcgttcaacctctactacaaccattacaaggcgaccaaactcaacatcagctcgttcggcggcaaggtgcccaacgtcgaaatcgagtccaccgcggtgattccgcgtctcgactacttgagccccgtgcgtatcttcggcgggcgcctggccggctacatcgcccagccgtggctgaagcaggaagtctcggtattcggcttgagcgacacccgcgaaggcatgggcgataccaccattgcaccgatcattctgtgggacatgggcaagaatctgacccttggcgccgcgctggaaatcaccgtgccgaccggcgaatacagcgtcgatcggctggccaacaccagcaacaatttctacacctacaaaccgctgttctccttcacctggctgccgaccgacaagaccgaagtctcgatgaagaccacctacagcttcaacgagaagaacaaggacactgactacaaatccggtcagatcttccacttcgattattcggccagctacaagctcaccgatgatctgatgctcggcatcaacggctactacctcaagcagaccaccgacgacaaacagttcggccataccgtgcagttcgccgggcaggacgtgaatgacggcgtgcgcggcaaagtgttcgcgattggcccggcgctgcacttcacctttctcaagtacgccagtgcggagattcgctgggccaaggaatttgatgtggagaaccggccggagggggaaatgttgtgggcgaaggtgagtattccctatgcgttctgagtgcatttgtaggaaagcgcacctggatttgtagcctgaaaacccgaaaaacgcataggtggaatacgcctacagcggcggtcgagattaccggacaacggggggaaacgtctggcagatttaaagggggcgcttgcagatactgggctccgttatcccatggttcctcaagggctcatggggtgcatcgtctgccagtgacgacaatgggccatgtccccccttaaactgccgagattgatcacggagatcactatgagcatattactttccccgttttactctgacttcgaatccgaagaagaggccgagagctacgatcgctggtttcgtgccaaggtgcaggctgcactggatgatcctcgcccaggcattccccatgaggaagccatggtgcggctcgaccaattattagaagagaaacgcaagaatcgacgcgctgccgcttgaatggagcgatcaagctctggacgatctggctgacattatcgattacattgaacaatacaattccaacgcttcagcggctctgcagcgcaaggtgggtgcagcaacgcaaaggctttcatcaattccctatggttacagatccggtcgggtaccgggcactcgggaaatggtggtcaatccaaactatctactggtctatcgagtgaacgggcacatcaaaatactgacgttagtccacactcgacaacaatacccactaacctcatcaacataaaaaagggcgaccaaccggccgcccaaacgtactgcacgagagtcttttacagcgtcagttgcccgcgctcctcttcggtcaactgctgtttcgcctgttcatccagcgccccggcgcccaacacctgcaccgggctgtccgggttgtaacccggcgccggcgcgcggctggcaccatcgcgggacggcgcgagttgttcgttgccgaagctcagcacctgcacggtgaacaccgacgcctgattctgtcgcgacgccgcttgctgctgacgcgccacgtcttccgccgcttgggtggccgaggatgcagcggaactggccgaggtgatcgcgccggtattcactgccgagaccaccggtacgcccgtcgacttgccctgcaccgaaatattcgcggcgttgaccaccgtcagcgcggcgatgttgacgttgcccgacacgcgaatccccgcctcgccggcatcgatggtgcccagcggcgcgatcaggtcgatgtcgcccggtttcacttcggcaatcgggttgagcgtagcgataccggcgccggtgctcggcaccgaaggcgacagtgtgacgttgccccaggtgtcgtaaacacgtttcggtggggtgtagaccaccgtggttttcgagccgcgaccggcgttgatgtcgccctcggcggaccagccgagaatcgagccaccgaaggtggtcatgatccggctctggccgagcaaaatgctgccctgcgagtacagctgaatattgcccgaaccctgagtgatgatccccgccgtggagggtggtgccgcgccttcgatgccgaacacctgaccgccacccggtgtgagcatctggatgtcgccgccgaacagggtcttgacccctgctccgccgtacagcgtgatatcgccgtcgtagcggatcggattgccggccacatcagtgctcgggaacagcgccgcaatcgcgttgcgaccgcgcagataactgccagtgcgcgggccatcgacgtcgttgtattccaggccgccggcacgcagttcagcgaagtacacctggcgggcgaagattgcctgttcggcgctcggcatcgcggcgtagaacgcttgcgcctgttcggcattaccgctgaagccatagccgagggtcagccagctctgcaactcgtccaggtaggtcttgaccactttgcccggctggccgttgagagaggcctgcggatcagcgaggttctgcgggttcaggtaacgcgcgatgaaccgtgagtaatccagcccttgcgcgcctgtgcccgcctgcagcaccacactggcgccaggccgctgatccccggccaccaacgaacccaggctggtgatgctggcacggtcttccatgaggatgttgcgcccggcattaatgtccagcgtacccgggccggcaatatcgaagctgctgtaaaggatgtcgcgtccggccgatacccgcgatacatctcgcgggtcgttatgaacgaacaggttgccggtcgaggtgatgacttcccgacccacgcccatctcatcgggccgcacggctgtcggttggcccaggttggtcccggatgccacgatgtcacgtccggcaaccatccagaccgggcctgcggcttcgtaccacgtgcgtttcgagttatcgaatctcaacgtctcaccactgcgtatccccaccagatcgccggtcaaggcataaaaccttgcgggtccctgcacgtcattcaatccggaatagctgtttggaccaaaagcgaacaacggataacgcgaattggcgtcaggcttaacaccgtcgctggcgtagttgctgttgaggggcttctggaccctactgctggcgaaggcttggaatgccggtttgaaaggcgtggcaatggccagtgggctagcgccggattgattgatcgcatagccaccggcatagatggaatcgccggccaacagttcgagttgtccggctgtcgaaggtgccaacaacagtgagtacgcggtagtcggcgctgcgttgccctcgccgtatgttgccgatggaccggcataaatcgacccctgagccgccacagcccgaagaatcgacggatagacaaagcgtccatcggtgggcgaggtattggcgccgctcaccggggtgagattgctgtcgacctccgccaattgagtactcggcgtgagattgccaccggcagaaaacagatcgatggcggtgtgatcggtccagagcgagaagccgctcaggatgccgccgatacccatattgccgctgctatcgagcagtggcgaggcgttgaacagacgcacccgaccgggatcggccgcaccgcccagcaccagatcaccccgggtgttgaggctcatgcccgagtcacctggaatcagcaccagaccaccggacgcgttgctggtggtcgaggtgaaaggatccagcggtcgggtttcacggacatcatgcgactgtgaaagggcaccgtactgcagattgatgccgcccagtgccccacccgtcaattgcgccgccccgcgcaaattgatcagcgcgccttgcagatcgtgcctcggcggccgagtcccgttatccccggcccgcgcttgcagcgatgggttgagtgcgccgccgatgcgaatgtccatatcgccgccgccggtcatctgcacactgccatcgctggcgacacgacctgtgctgcccacggcaacgataagcccttggctgcgcggataattgatggcatcgcccaacggtttgagcataccggcgtcacctccggcacgcaggctgatattaccgccgcccaaggtgccgaaaccggtgaagccgatcaggtacggttcggtattgccgtcggttgtcatcaactgagtggcgtaactgccgaagttgatccaccaggcggtgggcacatccggattgcctgtgccttggcgccacagccagttacccactgacgcgctggcaatctgctcacggaaaccgccacccgacgagagcgccttcttgcctactgaatcggcggaaaccgagcccccggcgttgatcgtcaggttgccacccaactgcggataccaggcttgatacaagctgtccgcgccaccgttgacccatttctcatagtcagcacccgccgtgcccagcaccgaatcgctgtccgagagatgcccgcgtttctggttatagagcggatcaacgttggctgactgagtgcctgcggtatacacgccgaacggcgagtccatgctcaggttgccggcggcgatcaggtcgagatcgccggtaccggtacgcaggacgctgaacatctggctatgagctttggcggttgtgcccggattattgccgatacacaggttcgggtagatgtcacagaggatcagcgcctcttcaggcaccggctcgtaatccccccctaacccgctgccgggcgcccagacccaacgcgccatcggctgacaaagtcccggaatcaaatcgcacatgaacaactggtcatcgggcacagggttataccccggcagatcgtagggattgcctggcgcccagaccattgttccggtacccgtcgtcacggtcacaccgtaatgagcatcggccaggcgcagattgccatcggtcaataccggcttcaccgcacgactgtcagcggcgccaagatccgcccccgccaccacgcgcatcgaccacgacgcactgcccgaaggcagcaggctcgccagcgcccaattcttgccttgctggtcgccggtaaacggacgcagttcgatcagtgaagtgccgtcggccagtttcacgtcggtcatcgacggaatcagcgaaccgcgcagcaagtcgagcgatccactcaatttcaccccggaagtgctgctcagatcggcatcgtaaaccgctggcaacggcacgcctttgggccagttcatggcttgcaggttcgtcgctttgttcaagcgaatgccggcacccaaacggctgttcgccggcaccgtcacactgtcactgagcaacgtccccgccgcgtacagcaggttgccactggcatcatggatggccccggccaacacggtgccggcgctaaaggtatacgcctcagccaatactgcctgagtcggcagcaacgtgccgctggccagcaccgcgccctgaattgtcacgtcatagttgagcgtggcgccgatcgggaactgtgtcccctcagccagcgaaacaccgctgcccggcacgatcagatcaccgccgaacggctgcacaccggcaatcaatttccagccggcatcatcctgagtttccggcggcggcgcgaaaccgtcgttgatgctgccgtaaatatcgaggttgccacccgcgcggattaccaggttgccggcctcaccggaaccgtacaccgccgggttcaagcgcgtgtgcggattgaggctggcgtagcgataaccggacaagtccagatcgccctccaccaccaggtcgccgtcggcggttttgctggcgatttccacgcccggacgcaaatggaatgcatcggcgtaggcagcgttgttcagaccggcgagtttgcgttgcagcagatcgctgttgcccagcgccgcattgatgaaggtgttgctgtcgccatggatgctatcaagcatggcctgatcgatcacttgatacggtcggccactgaccgcttgatcgacgccatcgcgggcatcggtgtagcggcgtgtagcgttgaggccaatggagcgagcgccctgaatggtcaacgcaccgctggcgtcgatggcgatgtcattgctgcccagacgcggcgcgttcaattccagggtgccgcgcagcattccgtcgtgttgaccggcgaggaaaccgggcagcgcatcggtgccgtgacgcaggtcgatgcgcgcgccggacgccagcgtgagcacgccctcgccggaattgagctccaccgtggcgcggttcggcgcatcgatgatcttgccgtagctgtcgacgcgcaggactcgaccatgggcgtcgagcacgctgttgccggccagcgtcagagcgtttttcgccgccagacgaatgttgccgacgcgctcgccactggcgtcgatcagaccggccaccgtcaggctaccgttgtccaccgagacattgatgtcaccagccttgaggccatcgccgatcacaagattgccttgcttgagctgcaaactgcggctgccgaacacctgtccggcgttcaggcgttgattgagcgcggcaaactgcgccgtggcatccccgccgaggttttgcgcgcggatgtccacgctcccggccttgtaaggcaccagcgtgccgccggcatcgtaataaccgctgctgccgccgaggatttcaccctgcaaatcgactgtcccggcagcgtcgcccagcgcggtggccgtgaggttgccggcctgatgattcttcgccgacagatcaatccgcgagccagccgcctgccggatattgccgttggcgctgtacagcgacacgtcgccgccccagctatatttattcacatcgttgaacggcaacgtacgcccggccatgtccagcaccgcagcattgccgagggtcaaatcgccttcggacttgaccgtcagcttgccgctggccagggcgatacggctatcgagcacgatgttgcgagcctcaaggttcaactcggcacccagcgcgtccgcccccccggcagccccgccaccgctgagcgtcagattgttgccagccttgagcacactgaccgacgccgcttcaccggtaagcaacggcgtccgcagattcaggttgccgccgctgtagcggtaacccttgaccgggtcgtaagtgccctgctgctgatacaccgcgaggctgcccttgtggttggcggtgatgcggtcgctggcggtcaggttgacgttggcaaaacccagcgccagacgattgttctgatccaggccgctcgcttgcggcatcgagtcgtaacccaactcgatacgttgcgcctgaatgtccagcgtgccgctgcccgtaccggcgccagcggtgatcacgccgccagggctttgcgtggcgccgttccagatcaaattggcggtgcggatgctcgccacatcgttggcattgcccaagccatagatcgccggagtgaccagcaccaggttctgcaatttactctggccggtctgcggatcgagagtgtcgaggctcacgttgccgtagaaattgaaagcatcgcgagtggtcaggctcagggtttccagcgccggtgcgccgtactgcgtatcgccacgcagcagtcgattaagcacgttctggttgagcatcaaccccgccggtacgcgactgcctgccgctgccagtgcttcggcgctgccggcgttgaccgagccgaccgaaagcgccaggtggcgcgtgccgaaacgcaccgcttcgtcgagttcgaattgattatccgtggcggccgtcagactgccgtccgaataaaggatcgccgggttgctgcacacagccgtggtgcagacaccgatgcggatcctgccaccgccggaaatgccgctggccgctttcggcgccagaacatgagtccagccgttggaagccagcaacaggctggattggtcaggctgatagaaatagccggccgttgagtcgtaggccacatcgccgcgtcccagggtattgatccccgcccccgcctcgaccgtgatgccaccaagggtcgacgtggtgcgcaacaagacttccggcgccgacaggatcgccccttcacgcagaacaatgtctttgctggtgccaaggaatccgatgatgttggccgagttgccgtacatgacattcggcatcgctccgatgctcaggcgtccggcgttgaggttgttgagcgtgtcagcgtagaccgagacgccatcgaagtcagcggttggcgcatgccctgcaccaaggatttcaaagttcgcgccggcattgcccccgcgcagtacggcggtgccggtaaagccaccctcggcggccttgaacagcgcctgcccgttgaactgcaaagcaatgtcttgttcgccaccggcgttcagacgcaagtccagcgtcttgccgtccatgggtgccagcgcacggggtacaccccttcgtgcggcatcgctgtagatgaactgggtcaagctggtttcgttgtattgcgagtagcggcgcaacacatcggcagacgtcaggatcacctgactggcgaggctgtcacgcaaagcggtattggcaatcgacatctgcccgctgctggtccaggaaccgttgcgcagttgtagcgcaggcgtcgtcccgctcggcgtcgcctgaccattgacttccactcggaatgcccccggcaacagggcaaaattggagggcagcaaggtgtaagtaccggctgccagaccgggcacgccggcgccaagggtgatctgctggccgacccgcggatctgccgcagcggcctctgccaccaccggcgcatacacgctctgattacccggcacgatggcgtagaccggattgctcgcaagccctggcaagctgaaggtgccgtcggcggcattgcgcaccaacggattgagacgggcatcggtggagccgccgcgccctgaaacgaaaccggcgccgcgaagatcaccgccaccggacagatcaagagtcgcaccgccctgtacatcgatgtattgcgagttgacgaccacgccattggtttggccagtgatgccattcaagatgaccgacttgtcgttgtagcgatagtcgatgccgtcggtggtgccaccgtaaggcatgaccagcccggcggcgctgaccgacgtcatgctgcccggcaacaggcgcacctcacgtgtggcggtcagaacatcgtcacccagggtaatcaggcccaacggtgcacggatcaccccgccctgctcgatggtgcctgcggtcaggctcaaactgccgaataccgagtaaggcaccgccgcgggtgccgcgccgcgaccgctgatccgcagggtgtgttcgttcgcccggtcggcgccctgatagccggcgcggacgtcagcctgcacgcccgtggcggggtagatttgcgccgcaccgagattcaagtctcccggggtccacaggcgggttttttcggcacggtcattgggcgcgaggaaacgcaggtcaccgctgctgtcgagcgacaccaggccgaatgcacggcggctgtatgcaacggcaggtccttgctgttgcaagatcgcaccctgcgtaccgaacgacagcccgttgccgacatccagcaggttcgccgaggcattgaacgtggcctgcgacaatcggttcgtgggattgagggtcacccgtggccgcgtcatggtgggcgcttcaaagtaagtaccgacaccggacaggcgcaggtacggcgcgcgcaaatagatacgtgccgcatcagtggaattttctgccagcgagagcgccccggcatacagattgaggctctggttcatgtgcaaattgacgtcaccgtcaaacgacagcaagccgttgctcagcagactcaggttgtcgaaaccgccggccatcaactcatccgcgctcaggcgcgtctggccgtagcgcaaactatcgtcgctatcgcccggccgcaggttggcggacagcctctggtccccagagccttggccgataatgatttccctcggcgcgcgcaccgcattgcttgccgaatccaagtacaacgggacctcaagcgccagctccagacgcccaccggcagcgccgacacctccggccgccgcacgcaagctgccctccatgaacaagccgttgtaggaactcaggctgatgcgcccgccatcggttgcaacgcgggtcggcccctgagcggcgatatcgacaacagcttcggtgccggacgcatccagtcgagcaccctgacgcacgatgacataggcatcggccgctgtggccgtcgccagtttcgtgtctatttcgccgccgatgatgatgctgccgcccttgccgacctgaccgtaggtgcgccccagaacatcaatggccgtattggcgcgtccggcgacatccagtacggcctgctcgccgatccagatcgaacggttgtgcgcagtcgaatccgccacttgattggaggtgcccgggttgatcgcgccaaactgttgctgacgaatatcaatcgtcccgccccaggcattcagttcaccttcgatcgtgatctgccccgccccgcgcagcttgatgctctgccccggatcgacactgatgcgcgaaccgtggcccagggtcaacgggctgttggcggcatcgatcaagccgatcaggctggcgccgccctgcaacgtcaggctggcgccggcgcgttgggtcagcaggcccttggtcgggttttcctggaacaacgtcggcgtccataactcaagcgccgtttgcggatcgacaccactgacctgattcggcgcggcatcaccaaaccggaacaccggcaggatgacgtcaatcgcggtgccttcggcaacatccagcccgctcaggccgatcaggttgtaggcggaaaaacccttgctgaacagatcgccggacagttgcagggtgttgtcggccaatgcctggtcggtctggccaacgaggatcttgttggcctgcaccgtcagcgtgccgccgcccgtaacgccgtagccacgcaattcacccgcaaggtcgagatgggttttaccgggcgccgaaatcgcactggattccagcgtcaagtcgccgcccttgccaccacgggtcttgccgttggccagcacagcgccgccggaggacacatcgagcagactgcccgcgccgatatcgatatcgccactgctgcggaccgataccaggccgccattcaagtacgcgaggttcgcgccatcgtccgggtttgtgcgcaagttgctccacacgccacgcgtatcgagtcgcacaccgtcggccacgttgacctgcgtcgtcttgtcggccttggccgtgagccgagtgtcggcggtatcgctggagaggaattgattgagcacgttgcccaggcgcaggctaccgccacgcgcagtcaggtcagcgccgatctgcacatccggggcatacagggtgatgtcgccaccgttatcgaccgtcagtgcgccgtcgacgacgacctgatccttagccgccactttgagcgcaccgaggcgcacaccattgagttgatcgttatcgagaaacaacttgcccttgcgtgcatcggacaccgccccggccaggtccagatcactgccggcaagcggacgttcgccgcccatttgcacctggtccagcgtcggattgagcgtatacaacaagccactcgccgcagcgacgtaggtcggctcgtaactgccgacgatcaattgcgctcgccgcgccagtgctgtctgactttgttcatagccgtcgagcaccggtttcggcgcctgattctgccgttcgccctgatacacctcgccgatcatttgcccgtcgagtaccgcattggcagtggcgatcaccagttgcccggcgtcgcggccgacggtgtaacccgactcgaaccgtgagcgcggcgcgatcagcgggttgtagaaatagctcgtctggccccagcgttcgctgctgtcctcatagcctttgtacaacccggtgtagagcagatcgcccggcgcgcgcgagacttcgtaaagtttgccgtcggcaccgcgcagccagctctgacgaatctcgccgctctgcacatccagcgtgccgccagacagattgatcagcgaccccttctcggtgaccacgtcgttaccggcgaaactcaccgtaccgccctgcgccatccactcgccgatgctgtggccctgggtgccgaggtagccgcccacttccagcaagccacccgccgtgtaccagcgatccgtggcatagccgttggtgccggccggcacgtagaccaattcgcggacatcgacccagacgtcgttgctgttgagcgcgcccttctcgcggttgatcgacgcgtcgcgctgttcgttgccctgcacgttgatcttgatgttgttgttttccatcgcgaccttgacgccgagggcgccggacacatcgatcatcgcgccatcacggaccacactgcgacgttgcgcactgaccgcgacctggccgccggtggccaaggtaatcgagccgttctggaactcgacgctgccgccactctggatctcgatgcgcgattgatcgccacggatgcggttgttggcgttgacgccggtcagcgcggcgtcgcgttgactgtcgagcgccgtgaggtcgctgctgtcgagcatgattgccgtggcgctgccctgccccagcgtgacgctgccggtactgtcagtgctcgggttgagcaaatgaatcgtgccgcgcgtggacaccgaagtgctggcgagcaaaacaccgttctgcaccacttcatgaccggccagggtgatgtcgccggtggcggactgaatcagcccgttgttggtgactttgccggcaacggccccggccttgaagcccggcgtgacctcactgccaaacgtcgtcgaaaaggtattaccctcagtgcccgagcctttgcgaatgtaaaagcgatcaccagcagccagcaccgtctgccctttggcggtactgatgctgccgtcgttctgcacttcgttgcccagcagtaacgcatagccaccggcatcggtggacaccgccggtttgtgcgtctcgatggacgcgccgcgctccaccaacaccttgccagccgcgtcggtgaacgtcggctgagtgccggtgctgtcgaaatacagcccacggtcgcggaactggatatcggtgatattggccgccgccgccaccaggttgcgcacgttgacctggctgctgccgctgaaaacgatgccgttgcggttgaccagcatcaccgtgccggcgcccttgatctgcccctgaatctgactggcgcgcgcactcgggtcgttgacccggttgagcacggcccagttcgcttgttgagcgaattcgaccgtggtgttgcgcccgacgttaaaggtttcccagttgaggatcgccttgtcggcggtctgctcgatcttcacggtggtcttgccgtcagcctgagtctgctgtgggcccttggcgttctgccaaccctgagccaggctgttatcgactttcaaaccgcccttacccagaccgtccggcacaaactgcaccgtgcccaaggcggcagcacgcccggccgcctgcgccgcttgttgcgcggcaatcgcggcaacggtgttgttcaacgtctggatcgaacgctgcaactgctgattggccttttgctgttgagccagcggcggtgtcatccccggcaagccgcccatgctcggacgcgccgccgcggcttgctgcgctgcgcccttggcagcaaaccagctcgaactgaacgccgtctgcgcctgcgcactgcccgccaccagacacaacgccacggcgtgcgccaacggcttgagcagccacagcgtcggctccacagcttcacgcttggaggacagaacacgggtacgacgacgggatgggcgagcgagcatcactacgagatccttttttgattgccacacttgggtggccaaagctgccgcaggcctgcaaaaacctgctgttacgacataggccgttggcgagggccgcgaccgaacggatgtcacacaaacttcatgttaggggagtaattgcgagcacgatggctgagtgccagaaccgaaaatggcagtggcgaacgcagctgccattggctcaacgaaggcgtatttcaaagaggtcgaccgataccgttacaaatggacgggttgttgatatcgaggttttcgcccgaagtattcgtaacaaagttggcgatcaccgcctctctcattttgtccgccatacccacgaaaccatgagcacggttggaaggcacatttcccgggtagctgtagtgcttgctgagaaaactcttgatctcgctggcgaccgcggcatccttgtaacactgagagaaaatcaggttggacgtcgcggaaatcgagtaaccgctgctgggtttggcaatcacttgcccccaggctgacggttcaacaactctggttggcggatgcaaaacaggcaccagtgccaaagtcgaatcagcgagtgtgggcagaacgccgttgatccgagcgactacggcattgttcttcacatccagaccatctggccccagatagccgatggaaccatcaacactgttgaccatcgcattgacatcgccatccgcgccgacacttacccagtttgaaggtatcgaggaacccgcattgatgcgcgcactggtgaaaatagcgttggtcgaaaaccggatcgggcagaccgcgttcaaatgacgactgagtacttcagtgccgccactcgaatagctggggtaaacaagccggattggagtgctgtcactcgtgcccagaagcgctccccaagtggtagcagcgccggacatcgcgtcgcacagttgcgccgaggtcagattcagagcggtttgacctgcctttttataaacaatgaccaccggggtaaccaccgacggaatctgtatcaaaggcccataggcagaagcgagggaagcgttgtaagttgcaatttcagtagcggtgagaatcgactcgctcgccgcaaaatgtaccgtcccggtcgtcccgaattgtgccgcgttgttggttagaaatgcagatttaccaataccgcttcccgtcgctgcatagctgaaactggcaggaaaaatactgtcagatgcccctttgtaaagcttggccgggatggttgcgccgcccccggtaacggcccctgccgaactcgacaccagtgctacgcctgataacaccgcgaccatcattcgctgcttcaacatactccacctccttatcaagtgccctccgcacgagggcaaaaaaaatggcagccccgaggggctgccattcataccgctgactgaaccaaccgacttacaaaggacgaccgatggtgttgcacacggtggtgttgttgatgtccaggttgttgcccgacgtgttggtgatgaagttggcggttacagcgtttttccacgaatcaggcacggcgacgaacttgtgcgcctgagtcgcggtgttgttgcccgggatgctgtagtgagtggtcaggaaggccttcacggaagcggccacggctgcgtccttgtagcactgaccgaagatgaagttggtgtaggcagcgagtttgtaacccaatgccgggttagccaccactggcgaccagttggcagggttggcagcctgggctggagtcgaaggagccgacaccgacgacagtgccagagtcacgttcagcgaagtaggctgaacaccgttgacgcgagccacaacagcgttgctggtagcgtcaacaccgtccggaccgacataaccgatcgaaccgtcaaccgcgttcacggtagtggcgacgtcggaagtgttagcgacgccgacccagttcgacggcagtgccgaaccggctggcagacgagcattggtgaaggtggagttggtggcgaactgggtcgggcagaccgagttcaagtgacggctgaggatttccgaagtgccgctggaaacgttgcgataaacaacgcggatcggggtggtgtcagcagtgcccagcaaagcgccccaagtggttttagcgccggagaaggcatcgcacagctgagcgctggtcaggttcagagcagtctggccggcctttttgtacgggatggcaaccgaagtggccaccgaaggcagttggatcagcgggccgtacgaagcaccgaattcggtggtgtaggtgctgagttccgaagcgctgaggatcgagtcgctaccggcgaagtgcacggtgccggtggtgccgaagccagcagggttgttcttcaggaaagcagtcttgccaccgccgctaccgatggcggcgtaggagaagttggctggcaggatgctgtcggcagaacctttgtacagagcggcaggcagcgttgcaccaccaccggtaacggccatggcttgcgcggaagccagagcggcgacggtcagagaggcggcgatcagagtgcgcttgaacatgaagaatctccttttcaactggtttgtgaacacaggttttcggggttgcttgcatgacactgggaagactcaccgggccctcgctggcgttggccgtggtgaagtcgcactgagaaattcgcaggttccggtgacagataaaggaaaaaacctcgggagctgtgaggcgtttccgaagggattttctcgggtgtttgttggggccggcgaagggtctggatcaggggtttggcggaatcgggctggagccgttggcgggtggttgcagatgacagaaaggagaacccgaggatgggggaatcgagggtcgggtgataccgcagtcctgggaaaaaatctggattatttattgccccgactggccccatcgctggcaagccagctcccacaggttttctgttgtgacacagatcgcatcaacaactccgccccctgtgggagctggcttgccagcgatgaggccaggtcagacaccatcaaaaccggctactggaccagttgattgatctcaataatcggcaacaacaccgccatcacaatcaccagcaccaccccgcccatcaccacaatcatcagcggctcaagcagcgccgtcatgcccatcgcccgccgttcgatatcgcgggacagggtttgcgccgcacgatcgagcatcggtggcaacgacccggttttttcgccgctggcgatcaaatgaatcagcaccggcggaaacacattctccacccgcaacgccgccgccaggttcacaccctcgcgcaccttggccgtggcctcagtcacgctcaaactcaagcggtcgttggacagtgtctgccgcgccgcctccagcgcacgcaacaacggcaccccggcgccgccgagaatcgccaacgtcgaggcaaaacgcgcggtgttcagaccgaggatgaagcgcccgaacagcggcaatttcagcacacgatgatgccaactcaaacgagccgctggattgcgcaggtacagacgccagctccagaacgcgcctgcgatgatcgccgcacacaaccagccccacgcccttatgaaatcactggcgttgagcatcgccaacgtcagccccggcaagtcctgccgcgcctgagaaaacgcgctgaccacctgcggtaccacataactgagcaagaaaatcacgatgccgatcgacaccagtccaaccacgcccggatagatgaacgcggtgagaatcttgccgcgcaggttgttgcgctcctcgatgtagtcggccagccgttccatgacctgcgccagatcacccgattcctcgcccgccgcaatcaatgcgcgataaatctcgggaaaatcccgtggccgcgccgccagcgattccgccagacgcatgccactgcgcacatccgcacgaacggcactgagcgtatgggcgatgtgctttttctcggcctgctctaccgtcgcgctaagggcggcctccaacggcaggctcgcgccaagcaaactcgccaattgccgcgtggcccaggccagatcgttgtccgagagcttggcgctgaacaatccaccgccgccgtgctgggcaacgttgctttccttgtgcactgacaacgcggtcaatccgcgcccccgcaaaacactgaacgcagcgccttggctgtccgcctcaaggtgcccggtttcgatcttgccgctggcatcggcggcttcaaaacgatagcgattcatcaggcgtcccgtgtcacacggaggatttcttcaggggcggtggcgccgctgcggatccagcgttcgccatcctcacgcaggctgaacatcccggccttggcggcggatgcgcgcaaggcctgctcccctgccccttggtgaatcagggtgcggatgtcgtcgtcgatgcagaacaattcgtggatgccggtgcggccgctgtagccggtttgattgcacgccgcgcaaccgaccgggcgccacgtccccggtgtcgccgggtcttcttgtttgcactgattgcacaggcgtcgcaccaaccgttgcgcgagcacgccgagcatcgacgaggccagcaggaatggctcaacgcccatgtcgatcaagcggttgaccgccgacaccgcgtcgttggtgtgtaaagtcgccagcaccaggtgaccggtcagcgaggcttgcacggcgatttgcgcggtctccagatcgcggatttcgccgatcatgatgatgtccgggtcctgacgcagaattgctcggagcgccagggcaaaggtcatgtcgatcttggcgttgacctgaatctggctgatccccggcaggtcgtattccaccgggtcttcgacggtgaggatgttgctggtgctcgcatcgagtcgcgccagtgcggcgtacaggctggtggttttgccgctgccagtggggccagtgaccaggacaatgccgtggggctggcggatcaggtgatcgagcttggccaacacctgcgcgtccatgcccagcgtttccagatgcagacgcccggcctgtttgtcgagcaaacgcatcaccaccctttcgccatgcccagttggcacggtggaaacacggatatcgatcggccgtccggccacgcgcaaggcgatgcgaccgtcctgcggcaggcgtttttcggcgatgtcgagttgcgccatgatcttgatccgcgacaccagcgcaccgtgcaacgccttgcgcggtgagaccacgtcccgcaacgtgccgtcgacgcgatagcgcaccaccgaatgggtttcgaacggttcgatatgaatgtcgctggcttcatcgcgcgcggcctgggtcagcaaggcgttgatcatgcgaatcaccggcgcgccgtcctgggtgtcgagcaggtcggtgatttccggcatgtcctgcatcaggcggtcgaggtcgacttcgttttctgccgcgccgacaactgccgccgcgctgccggtgtcggcgtacgcgctggcgagcaagccatccagctcatcatcgcgcacgcgctcaatcgtggccgcgccaaactgccgccgcgcctcgctgatcgaccagcccggcgtcgacgggcacaccgtcagcacgccatcgcacaaaagaatgcgctgcgccttggcccaggcgtaaggcaacacactcatctcaaaccctccccaatccctgtaggagctgccgaaggctgcgatcttttgatctttggccgtttgagtccgtcgaagagcaagatcaaaagatcgcagccttcggcagctcctacaggtccgttttccaaatcatagggtgatgggggagtcattggatgggcaccgctttgatggttgcgcgtgggccggagctcggcaacaccgcaggcacaccctgcgccgccgtcggcaactgcggcgcctgcatgtccggcatcgcccagctgcgttccggctgcaaaccgccctgggcgcggcgcatgaagtcgtagcggttgagcgtaatgctgcgccccgcttcgctgtcgcggatgatgtacgggcgcaggaacaccatcagattggtcttggtgatcgcccggcgttcattgcgaaacagcgcgccgattcccggcagactgcccagccaaggcaccgcgtcattgctctggctgtagccgtcctgcagcaacccgccgagcaccatgatctggccgtcgtcgagcaaaatactggtgtcgattgcacgtttgttggtgacgatgcccgtcgatgtcgcgctgttggaagcgcgttcgtcgatgctgctgacttcctgatagatatcgagcttcaccgtgccgccctcggaaatctgcgggcgcacattgagcttcaaaccgacctcttcacgggtcacggtctggaacgggttattgctggtgccgccaccgccagtcacataactgccgctgacaaacggaatggtctggccgacaaaaatactcgccgcttcgttgtcgagggtcagcaggtttggcgtcgacaacacgttggtgccgcctttgctcttcaacgcccgggccagcactttgaggtcaagaatcttgccgatcccgggaatgtccaccgtgccgttgacgtaacccaggttcaacccctgcggcagcacgtcgatgctggtcttgccgttgacgttgatccccgaaccacccagattcgcgccgccgatcacgccgttgccgccgagattaccggtctgccattgcacgccaaactcactggcatcgtcctcgccgacttcgacgatcaggctttcgatgaccacttgcgcgcggcgttggtcgagcagatcgatgacttcgcgcaggttgcgatacaccggctccggcgcggaaatcagcaaggtgttggtggtggcgtcagcctgaatggtcaccccgccagcactgaaggcgacgttctgctcgctgctttgcgcaccgccactgccagttgcgctgccactgctgccctgagcgtaactgccgcccgtgctgccgctgctgttggtcgatgttgtgccgctgctttgcgtaccgctctggccgctctggccgttctgcccagcactgccgccagtacttgcacccatcgcactgagcaccgaacgcgcactgtcgctggtgccgctatcgctttcgccagtgagcaacccacgcaacgcctgcgccagtttcgccgcttgcgcattgcgcagatacaccacatgcagattgctcggattgctctgcgcgttatccagtttgtagatcagattgcgcgccagttccgtacgctccgggctgccagaacgaatgatgatggtgttggaacgcggatcaccgatcaccgctattttctgcgtcggatcattgcctggcgcatccagcagctcggcgaccatcggcgcgatgtcggcagcgatgccgttctggatctgcaccacatcggtatcgatcgcactgggcgaatcgatgctggcaatcaactgcgccacacggttgaggttatcggcgtaatcggtgacgacaatggtgttgttgcccggatacgcgttgatcgggttgttcggcgacacgatcggacgcagcaccggaatcaggttcaccgcgttctcgtattgcagccggaacgtgcgcgtgagcatgccgttgcccgcaggctggtcggcgctgtaaaccggcccgccaagcaatttggcatcagcttccggcaccacatgcgccacgccgccgacatcgaccacgctgaaaccctgcatgcgcaacgacgccagcagcatgtcgtacgcctgcttcgccgggacctgaccttccgagaccaacgtcagagtgcccttgacccgtggatcgaccagaaactgccggccgctggaacgcgacaatgaacgcaccaccgcttgaatatcggcatcgacgaaattcagcgtcaccggttgatcgcccagtggattgcccagcgccgcgctgctcgctgcaacggcgcccgtacgtgcgcttttgctgatgttgtgcagttgcttgggcgctggccgcgcctgtgcttgcgcccgttcgcgatcggccaccgcatcgccgctgcgctgggtgttggccagcggccggccgagttcactgtcgaccagcaacggcggttggttttgtggcgcattggtgttgctgcacgcgctcaacgccatcagcagcatcggtaacgccagacgtgccggtttggatcctgaccccttcatgaagcttccttagcgcccagcgcctgatccatgcgaacggtgcctgacaaagtgccggcagtgacttcggtcgaggggttgtccgcgcgttgcaaacgggcctcgaccacttgcagagaacgttgtgccgggttgctcaacagccagtcgagcacggcgtcggccggcgccgcgtcgaaggtcaacagccaggcgccctgtgcctcctgtaattggtaatgccccgccaggccgctggcctgcagggtctgctccagcgactgcgccacgctttgcccgtccgggcgcacgctgacttcgcgcagcagcacttccagcgcttcggtctgcgcgcgcagctttggcgtctcggtttgccaataggtgattttcttcagcggcggctggattagcgcaacccacagcagcagcccgatcaacgcgatggccatcccagcgaccatgcgtttttcgcgcagcgccaacggctgccaacgcgcctgcacctgagcgttgaagcgttgccacttggcgcgatagagcgcgagcgaggccttattcatctgcttccgctccgccgctgtcatcgctgtcacttggggtggcttcagtagccggacgcaaggtccaaccctcgtcgtctgccgtgacgctgataccggcctgggccaaggtgctttgccactcctgatcattgccgccgcgacgggcttcactcagcagactcaactgcaacgcgccgtcgacaaacgtcagccgctcgacactgccggccatcgacggcatgccgctgccggcctgcaacaccagacgattgaacgtctgcgccggatcatccgccgcgcccttctgccgcgccgccagttgctgacgcgcctgctgcaacgggttgagaatcaccggcaactcggggaacgcctgctttacccgcaggttcatctgggctttcaactgctggccctgcccggcctcgcgagcggcatacaggttcaaaccaatcacccacaccgccacggccaacgctgacagggcgatcgccctgccccagccgcgatgctcggtttgttgctgctggaccgcgccatgcagcccccaacccggtaacggcccggtccagcgctgcgcatcggtcatcggcaattcggcacccggcggcggttgctcaccgatccaatgcaaagtgatgcccggttcccacacgacactgtcgaggctgtcatcaaacaacggctgcacccgcgccgcttgcacgctatcgcgcaacaacaaatgaccgtcctgcacgcacgcgacggtgccgggcaacaccggcaaacggtacggcgccgggtagagaccgcgcaggttcagcccagcacttttcagcaactgagcaaaacccaacaagcgctgccgaggcgcccaagcgatctgcacctgcccggcctcgtcccgcgcgctgtgcgcgatgtgcatctcactgctgtcgccgagcatcaaggcctgcgccgcacactgcaccgccgcgacaatcttgttggcgggcagcggcggcaaatcgagactcgccaacaggctgtcagccgggtgcagaaaacacaccagcggcggcagtttcgactgctgacttaactggctcagagtgtggcgttcttcccgcgtgacctcaccctgccgatccagccaggcgcaatgcaattcactctgtaaatccagctccgccaagggcggcaacgccactttcaactggctcatacgcccacccgcgaccaaatcacctgcggcaagcggtcctggctgcgatgcagcaacgcctcaagactgacccggcgctgatcgcgccgcgcctcgccgcgcaggcgaaaccagtcactggtgatgccgaccttgacgctggtcagctccagttgcggcatgcgcaagcggttaacgaaatcgccacgattgataaaccagcgcccggcatcgcgctcggcgatcagcgcattggcacgctccagcgacagccccggcacatacgcggccaacaccggcgcggtggcggtgttgccattgagccaagtggtcgcggggatcaccgtcaggtacggcgccagtttgccgatcaacgcctcatttacgccgtcgacactgcgcaaatcatcaaggctgcgcagcatcggcattgtcggattctgcggtttgcgtgaagcatttggcgacgtcgcacgaccactgtcgaaaccacttttcggcgcctctgcaatctgcgcattcagcagtcgcgggtaagaggcaatcacccgctgactgatgcgctgactcaacccggcgctgaccccgatcaactcgcacaagcgctgaaacgccgcgacctgcgcctcatcaacccgctcattggccaccagattgcgcaggttgaacttgccctgctcatcctccagtcgcccctcaaaaccttgcgcggagagacgctgcgcccacggctgatcgagccgggtcaacggatcgcgctgacgtgcatcccacaacaattgacggctgatctccaacccacccagcaccagccaacgcccctgcacacgctgctgatccgcctccagcgcacgggtcgacacgctctgacgcgtcaacatgcccgccgcaatcaccgccaccacggccgcaatcaacaacgcgctgataatcgccatgccctgttgcttcgccccctcaggcgagcggctgttcatggccggccttacaactgccaggaaccgatatcggcattcacgccgtcgccgtcaggctgaccatcggcaccgagggaaaagatgtcgatctcgccattcgcgccggggttgaggtactgataaggacgcccccacggatcgttcggcaagcgttccagatacgagcgccaattgctgttcttcgcatccgccggccgctccaccaacaccttcaggccctggttcatgctcggataagtgccgtgatcgaggcgatacaacttcaacgcctgcatcaacccaccaatgtcctgcttcgccgccgtcgcccgcgcctgatccggccggtcgagcaccttgggcaccaccatcgccgccaaaatccccagaatcaccacgaccaccatgatctcgatcagggtaaaaccctgctgcccacgcggcgtgcgcatcggttgctgaagcgatttgaaaggtgcgatatccatctcgacataccctggcttgattcgattcgacgcgcagtgttgcaagaagatatgtcagtgatgttgaaaatcctcgggtgttttcgtcgtcaagccgtcaaggacgcgggttagcgtcgagggctgggttttggctttgggccatgtatgcgtgcgcgttcgcgggaagaaggtttcacgttgattgaggtgctggtggcgctggcgattattgccgtggcgatgtcggcggctgtgcgggtggcggggttgatgacgcagagtagcggggttttacgggatcggtcggtggcgatgattgcggcgcagagtcggatggctgagttgcggcttgagggtcggttgccggttggcatgaaggccgttgagtgtgatcaggggcggttgttgttgcggtgtgagcaggtgattggtgcagccgaaaatgggcggttgctcaagattggtattcaggtatttgaccgtaatcaggatgctccgccgttggccaggctggagacattgttgtcacgaacggaaagcccctcaccctagccctcccgaaacgtcggaccgcccagaggtagaggggaccgattcggggaaattcgagagctacaccgacttgaacgtctttcattgaatccaaaatggccaagctcacaaagccaaatcgaaggcccttcaccaaagccataatcgctacgttccttcaccgaaccataatcgccagaatcttccaggtcgacgtaccccgcaagacacctcggtcggccccctctccctccgggagagggctggggtgagggccgcttctactcgagaagcacccagaatcaccaaaaccataatcgccaaaatcttccaggtcgacgtaccccgtaagacacctcggtcggccccctctccctccgggagagggctggggtgagggccgcttctactcgagaagcacccagaatcaccaaaaccataatcgccaaaatcttccaggtcgacgtaccccgtaagacacctcggtcggccccctctccctccgggagagggctggggtgagggccgcttctgctcgcaagcccccaaacccggcaacagactcgccacgttctgcgcaatggcctgaaccaaagcaaccaatcaatcagccccatccaaatcaaccagccccaccaccggaacctgccacgaaggctttttcccactctgaccatcaaacacccgacgcgcctcgcgaaaatcatcgacgtgctccacaacccacgtccaaatcggcgacatacgaaccaacaactccatccccaacgccgtcagctcatactcgacatggggcggcacttgatccaactcccgccgtatcagcagaccatcgcgttccagcgcccgcagcgtcttggtcaacatgcgctgagtcacgcccgtcatttgccgtttgatctcggcatgacgcatcgtgccgtacacacccagggcatgcaggatacccagtgaccagcggctaccggcgtgagccaggacttcgcgccgcacgccatcatcgtctcgtcttagcgtctggcagatcgcttctgcctggctaagggtttcctcatcggtcatgtgtccccctggtatcacgcgtgtgccttcttctgagcgctgcgcaatcgtgccagcatcgacaaatcatacagacgacggatctcaggagacatcatgaccgcagcgacccacccttccccacaatccattctcgtactcggcgccggcgaactcggcctgccggtgctgcgcaatcttgcgcgggtagccaagcgctcgcccggcagcaccctcagcgtcctgctcagggattcgaccatcaacacacaagcccctgagaaaaagcgggaaatcgatgaactgcgcagtctgggcatccagctaatcgctgcagacctggttaacgattccatcgatcaactggccgaagtgttcgcagcattcgataccgtcataggctgcgccggcatggtcgcaggccgtgaaacgccaatgaaactggcgacagctgcgctcaggtccggcgtgaagcgctatttcccgtggcagtttggcgtcgatttcgaagtgattggccggggcagcccgcaggatttgttcgatgcgcaactcgacgtgcgcgagttgctccgcgctcaggataaaaccgaatgggtgatcatctcgaccggcatgttcaccagttttctgttcgagccggtctttgaggtcgtcgattttgagagcgacaccgtcaacgccttgggcagcctggaaaccagcgtgacgctcacgacaccggaggacatcggcaagctgacagcggacatcgttttcttcgaaccgcgctttcgcaacgagatcgtgtacctgtctggcgacacggtgacctatggacaagtggcgagcctgcttgaacgtgtgctggggcggccgttcaagcgtaacgtctggacggttccgtacctgatgcaggaactggaaaaagaccccacccaccacatcaaaaaataccgcgccgtatttgcccaaggcagaggcgtgtcgtggccgaaagcggggactttcaacgagcggcagtcgattcaggtaacaacggctgaacagtgggctcgggacaacctgccagtcgattgacgcaaagaaagccccccaatcgcaggtcctgatacgcgtacatcatctcaacagttatcgcggctaaagagcctgcgcactcccaccttggaacacgctcaaaggtgggagcgagcctgctcgcgaaagcgccagaatgaacacccgattaatcaccaagtgatcccgcctcccgcatcactccggcaactgcaaattatccagcgcccgattcaccgccaactccccgagcatgatcaactgcgcaatccccgccagcgcatggcgctgcgatgccggtaacaggctggagacgttctgggcgatggttttggccgaagcgagtgttgcactggcatcgaccagcagttcttcggttttattgtccgccgtcacggcgtacatcccacggtttttacgtggaggcggcgtggatccgggcggacaaaggtaatggtcgagcgcgcggtcggcggcttcgtggagttttttggaatcgatggattcgtagggagacgtgcagttagattcgggcgggttgggtgttggtttgatcatggtgaagctcctattagtgtggagccgccataactgtcgctaaacagaaaggtggcggctgtacgcaggttagcgaaccggttataggcacccggcagacccgagggtctcccgcatacagccaccatagcggagtcgcagacatcgagtctgcgacaaagcatggaacgctgatgcacctattacaaaaagtcgagtcgctaaacccggtcgctgattcatcagcgaccgcaccacaatagaacccgcaccctaggcgcacaagccggcggattctggcgtagctgtaggcaaaggcgcaaggatatgtagcctgagagagtgtctggagatgtctttttaaacgttggtgtttatcgcgcctcatcgcgtcctgccgtctaaaatcgctcccagcacctgttgccaagaattccccctgctcgccctgcctcgcggccacatccagcagtcaaccaataatttgtaagtaaatattgagcgcgccgcctgcctcgggcatgctgcgcgcagcacatttacatggacagtaaaactttatgcgcccctccaaggacatgcccttttcttcgcgcgtacacgctggacacccccgcattattttggcggccgatacccctcgccccatatcgactccattccggtcaaggaaaactgaaactttgaaaaggaacatttcatgagtggcaaacctgctgcgcgagtgacagatccaaccaattgcccgctcccggggcatggcacaaaccctattgtcagcggctcgcccaatgtgaatttcgacggccttgccgccgctcgaatgaccgacaaatccgcctgcggtagcccaattacgggcgccgtcagcgctacggttttcatcaatgggctgaatgctgcgactaaagacagtaccggtggccacggcaacgtggttatcggcggatccggaacggtcattattggcgacaccgtcgtatcagcacccttcagcggtctgctgccgatgcccgtgcactttactgacaagttcagattggttgaccaagagtcgggcaaaccgctagcccactttgaatacgccattcaacgcgctgacggcagcatggaacatggcgtaagtgatccgatgggttacacgcatgtagtgagttcgcacctgcctgaaaccatcaagctgtttcttgaggattaaggcatggctgaagtggttagcaagagtggcaggaaaatgtctcccgtcgccacgagagaagtgacggccgtcaaagacacctcccctaaaactgtagcgctggacgctaaaaaacagctaagacgggcggagaatgaggagtatttgaaggatccgaacgtgaaggcatatttggctgccattgccaaagccgaaggcggtgactaccacgcgaaatatggatatggctgggcaaagagttttcaaaccgggaaatggacgttcacagatgagtccacccatccaggcgccggtttcggcggatcaactacggcatcgggcttgtatcaaataaccattgccacttggcgcgagtatggcggcaagatggggctgaccgactttacgcctcatacccaagaccttatggcggtcgacattctgcgcaccctcggtgtgatcgacaagatcaaggcaggtgacatcccgggcgcgatgccgaaagccgcaacacggtgggcggcacttcccgaggggcccggcaagaaaaatcactatccaccgcaaccttacgccgaatatccggattttttgtcgtactacaaatcggctggaggaaccgtcaaatgaaggctttgcacctcatatttgtcgcactttattgcacgggtatcagcacagcgtttgccgatggctcacaggcgccaaacgacaagcgcgggccagcaggcatcgtcttcggtgagcgtttggtggcggccaagtccaagctaatcaaacaaggctggaagccaacgccgatgcataccaccgacggttatgaatacagcggcgttgagcgtgagttggctgcacgcaagttcatcgaactggatacctgttctttcgatagctcgcgctgcatcttgtactactcaaagaaaggcacctgcctgcgcgtcgataccatcggtgaacagttcaaggacatgacggtgacgcgatggaccgatgaatgtcctgaaatgcctcaataaccagcccccacaggtttcagcctcgcacacactatctgtgaccagcctaaaaccctgtgggagcgagcctgctcgcgaaggcgccagaatgaccacccaatcaatcaccaggtgatcccgacacccgcatcactccggcaattgcaaattatccaacgcccgattcaccgccaactccccgagcatgatcaactgcgcaatccccgccagcgcatggcgctgcgatgccggtaacaggctggagacgttctgggcgatggttttggccgaagcgagtgttgcactggcatcgaccagcagttcttcggttttgttgtctgcagtcacggcatacatcccacggtttttacgtggcggcggcgtggaaccaggcggacagaggtaatggtcaagcgcgcggtcggcggcttcgtggagttttttggaatcgatggattcgtagggggaaaccgaggcggtttcgggcgggttgggtgttggtttgatcatggtgaagctccatatttatacctggtggaaccaccaaaacctgtcgctaaacaaagtaagggtggcagctgtacgcgggttagcgaaccgagaggtataagacccggcagacccgaaggtctcccacgcacagccaccatatcgtagtcgcaaacgtctgcgacaaactggagcgtcgttgtacttatacctagtcaggtcgctaaacccggtcgctgggttgccagcgacacgtagacgataaagaccaggtacaaagcgcacaagccggcggattctggcgtagctgtaggcaaaggcgcaagggtgtgtagcctgagagagtgtctggagatgtctttttaaacactggcgtttaatcggggccttgctgcgccgatctcccccttaactgggtcaagccctttcccccggttaaaaaataacgagcactcataaccgggcataggcagcttcgaaatcactgagtgcttggtttactttgtatcgaagcatcagcgatgcggaaagcttcaccattgcctcaaataggacatgacctgattgaatctggcattgaccaacacaatgtccggcgtaatcgccaggctcatacgcgtaaacaatgtaaaaaaccctgcccgaatcctcccgactcaaccccgccgtgagatgtgtgacagagctatccgacactgggagctcagatcgtgaaaactccagaacatcatcgaaaggaatgaacatcgccgaagcagacatcacaaagagactcgcgatatccaacgcctcctcaacgtttttgagctcgggtgtcgcgtactcgtgctcaagaaaatttcgcatatcgacaactttacgcagcagactgggtgccaataaccctagcgcccttactcgctcgatcttcttcggcacgttccatctaagtgaaggatagccaaaagagatcaacaactgatcaagctgtccgacaatggcgcgtttcacgttagtcgttgcgttaacaagggctgccaaaccgccccgttcaaaatcgtcttctgccaaagtcaaaaattcaatcggagaaattttcagatctgtcattccaaaacttccgcctcccgatgccactccactgccgctcaaatcaaatccatgagcgacgcaaaactctttgatttccatctcaactcccggctaattggcggctacaggcatacgttggaaatcagtgtatcagcgaaatttcagctactcggtcgattagagtagttggtctacgtgccttcggtaagcctttggggacgtattggttgtttcagaaaataggccagtccctaattactctgggcgcgatggcgaaagcagcgataaggtgggcggcgcgtgccgaaggcctaggcaataaacaatcccacgcccccttccgccgggtatccggagtttttgtcgagctagaaatcggctggagaaactatcaaatgaaagcgtcgatcctcgtactttccgcactttactgcatcggtattagcatagcgcttgccgatagctcagaggcgccaagcgcaggcatcatcgtcggtgaacgtttggtagcggccaaggcaaagctgatcaaacaaggctggaagccgacgcggatgcattccaacgacggctatgaatacagtggcgtagagagggagctggctacacgcaagttcttcgagctggatacctgctcgtttgatagctcgcgctgcatcttgtactacgcgaagacaggaacttgcctacgcgtcgataccatcggtgagcaattcaatgacatgacggtaacgcgatggacccgcgaatgccctgaagcgcctcaataaccacacgaagacggcacggtaataatcaactgctcccacaggtttcaacgtcgtacacaacatctgcaatcagcataaaaccctgtgggagcgagcctgctcgcgaaagcgccagaatgaacacccgatcaatcaccaggtgatcccggcacccgcatcactccggcaactgcaaattatccaacgcacgattcacagccaactccccgagcatgatcaactgcgcaatccccgccagcgcttggcgctgcgatgccggcaacaggctggagacgttctggacgatggttttggccgaagcgagtgttgcactggcatcgaccagcagttcttcggttttgttgtccgccgtcacggcgtacatcccacggtttttacgtgggggcggcgtggaaccgggtggacagaggtaatggtcgagcgcgcggtcggcggcttcgtggagctttttggaatcgatggattcgtagggggaaacggaggcggtttcgggcgggttgggtgttggtttgatcatgagtgaatctccaaatcatagaaaaggagccatcatctttcgctaccaaacgaaggggtggtggccatacgaaggttggtagaccggtgacttggagaaccggcgcgcccgaagacgccctgcgcatggccaccataaatacacagccccaaaaaggcctatatcgggtgacgctatgcgccaagtctagccgggctaccaaacccgatcgctgattcgtcagcgaccgaaccacaatagaatccgacccaaaagcgcacaagccggcggattctggcgtagctgtaggcaaaggcgcaaggatgtgtagcctgggagagtgttttgaaatgtctttttaaacgttggtgtttattcccgtaacgcctctcggaatagatccgtccacatccctagcgaaatgctcaacctcgcagcccatcgaaaccccgctcgccgcaaaaccgtgcttctctgccgtctggccctctacccttctgacgtccagcgactgagttaccggaagtggtcaggatgactatgctgttgacttacctagctgaaaaaatagtcaggcaatgccaataccgaggttgatgcatagaacgcaaaacaccgatctgacatcaaatcgaccaggcaaataaagcaacggagtgcgagatgaaagtcatcgcttttttagccatttatctcgcaggtggggttgccctgtttcccttcctggacctcatgcgtcccgtagatgtgtttctcgaccgtttctattcacaaattttcctcggttccggcgctgatgtagcagagcgcctaagcctgagctttatctatgcaagtctgtttcatctggcgtggtcggctttattttctgaatctgcaaaaagctgggtccccacgattaacttcagagacctttgctatctagctttacgatgtctgagtttattttgcgtcagcctgataagtctcgggctggttggaaaaaccaaccaaaatgtgccccgtacggacgttcatcaatatttcatttttttggtgatctgcatgcttctgggtctttgggcgtggtcgctcaaggattttctggtggcagcctttcattgcaccggaagaaaaatcacaggaacgactaaataaaagcaggcaataacccaggtcactttttttcgaatgcaccatgggaaattatccatactgatttataacacctgaaatattgcaatatttgctggcaccatcaagatctggaaagagtgacagatgattaacattcatacgattgagagactttaatgcctttagcctgtcaacggctggcatgtagattttcagaagaggcgcgccatttattgaagagtctttaaaatttgaaaccacccactcatcaaccgttattctgcttggaacctttgtaaataacccccgctgattaatgagccttggattttcattagttaatggccgaataaaatccaaggtatcaacttgcacaccatccccctctaacactctccttttaatttctttattttttcgctcacatgcgtttctactaagcgcataaacaacaacttgttcgtcatactcaatatcatcaggtagaaatgcaaaatatgaagcgacaaatggggattcagaccagtctagcagtggtgtgtgaagaccgtgatgctgaccaagtgcccaccactcatcatcatccattaccgtattaggaacctgccctctccgccccctgctagcgtacttaaatttatgcagatgtgcttgagcatctattaatgactttccatctttatctctcactctgtctatggtcggttctagcctccaactgacgttcgcgtgacctctaaaaacatacgactcaaaatctgttaatttttcttgaatgaatgatgagaaaccgttccacgagttgcattgcactgacctaataccttcgaacactttactcgacttccagtcgtggcctttgggtacgtcatcacttagactcgtcattattcgcactctcttaaaccttaggaaaacgggatcgaaaaagcggagctgatttatttttaattagctctcttaaagccagaaaacttaggataaaggcgagaccatttattgacgcatagtgacgcatgacaaataagtctcgtagaagtagaaatattaaattagggacgatcatgatctgaatcccacgtcgcgattttcttcatcgcgtcgagcgcactcaatcgcacgaataagagattggcgcatttgagttgcccatcgactgacagcaggattattagcaatttttgccaactgctctagtcgcacaagcataggttcaagcttcgtagcataggacccccaccaactaccagttgtgagtcgcgaagctagtgggctcatctccccagcttcatgaacatgctcttcgataaaattcacgaactcggtgttccagtttgccgtgatttcggtgccgtcaaagattttgatccactgcagcacaataggtagccttgcgggcctgtcctctagcatccaaggtacaacaatatccatgggcacaaagtctagtattccagcatgcgatggatttccgaactcggtcccatataggcccgaaagccggtgcgcttttaggggatcgattgactttagttgatctgtgtatacttcccaaacaatctcaggataggcatcgatcatcttccctagaatatctcgcgcatattcagcaaagtcgagctgtacggtgtaatcagaaacatttatcagagaagtcacaaagcaagtgcaaatcctagcgaaacctggatctaccaaatcattattgaatagcttagtaatcagttccctccaatgataggcatccatatgcccgattttagctctctcaaagagagtcgcctgaactacgacagtttttataaggcagccctcgtttgctaaaatcccttttttatcgtgcaaagagtaaatcaaaaaatcaactgctgcccacgcaccttcagctccagaagcaaggagaacgtctataagctcaagaatcaattcccaagacacagcttcgcgctcagcccaaataccgagtgagtgaaaattccacggagatatctccccatcgcggagacgctctatcaaaagtgtgaacagacgatcatcaacgccgacagatgagattagatcaactgtataaggggctaaatcattaatactcagggcagtatcaaggtacccacgagccgagtcaccatcgattttgttaagcccaaagagaatgctacgcagcatgtttgcggtcgcacttgcacaattgtcacgtgccaaaaacccaagagtctgattaattagactttcgggatcatcgacgtgcatcgcaattaaaatcaaagttgaacccgcgccatggtaagttcctgctgcaaacgcctctagcacgggctgaaaatacatagactctctagggcttattgcaataataccttccaccaccctttcgccgtagtaatgatcattccctccatcttcgtcatagcaaacatcgggatcatggagatcgagtcgccagccagcgctgtagagcagaactctctcgagtttgtcatcgggtataagctcatcgaacaaggagcgtagtcggtccctgtattcctgcggggaagattcctgatcaaagtagagccaatcactgacggcagttagtcctcgatgccatcgtggccggaatgccttgatttctttaattgcccctacgacctcctcaaaaatcgcaggaatttgcaacaacccacgcagatggctaccaatatgattaagacctatttcttgaagaggatcagtaccatcgagagcaattcctttcaaccgagcgagcgcagcgcggtagtaatcgaatatctcgccgtaggtcttgggataccagtcacttaaaggttcggaggccccgatcctctcttgtccagaagaacgggagaaatgatgagtagtcagcatactttccaaagcatcgacgcatatctgtcgaattcgtaaatcagagctttgaaggccttggtccaaaagtgcaattttattcgagggctcagcctccgttcctgagagctgcattttgaaaagcgatttgaattgcccagtcgcattattgccccaagtttcattctcgcctgctccgagttttaacagcagccccgccgcttccgcgaacgtttccttcctaaagacgagcttctcaagtgcccagactgtataacgacgccccgagttaaactctagtaattcatccacagtcagtgggccaagcaggttgttaagatgctccatgactcggtccggcgccatgtgaacgaaacgatcgagtaacttcgatccatgctccgtatttagctcgaccttcgttggaagtagctcaccaagaagcctatcagctgcattactgacttcgatggaccatgacacccagcgcaagcggccagcaagacgaagttgtagtataggactgatctctcggaacaggcgctcaagcgtgccgcctggcatgtatgccagccaagcgttcgcgagtcgcattgcaagcggaacggggcgcacttcagcataatcgccgaggcgcgcgacaacgccccgatctcgaaaaccgcttagcagacgaaaaagggattgaggtttacggtcaataaactcagccacctcctcgagttctttgccgggtttgttctcgacgccaagggcagaaaaaagacttaatgtctgaagtgcaaacaatgcttcgtcatctggctccttgttaccccacacaattcggctgatgagtgcctccacagaagacaatgcctcatccccattcattgttgcgcgggcggcgagcagagccatactagggaagccttgtgcgagctcacgcacaaatagcacgtcactggttacttcctcggtggaaacatctctaacaattccctctatcaattcatcggaagcggcctgcacctcaataacgaggcttctatcaaaagcatcagattttgtttctacacctactgttatcaagatagcgttagcattcccgcgagccatcgcctcccaaaggcgcatgtgaatttcatcaggacaatcatcgacgaccaaaatgcagcgcgaccctgactgcgccagctctctagcaatattaacgacgatgttctttacgtcgtcataaacaacatacacaacttgctttgagtcgaggaagtcgtttggactaccatcagcagtgctaaacaacgcatgaataaacctcgttttaccataccctgaaggacctacgattcgtatcgatcgtccgtaggtatagaagaattcatccagcgttgaccgaaaggtttgtatgctctgaagttctttaagacccggctgatccttcttccattgcctaagaggcgctccacgcattaggaaacgctcctcctctaagcattggaatatgggttcactaactccaatatcagacgaccaatcttcatagttacgaaatccgtgaagatgaagttcccgcaacgtagcgttaagccacaacgcaacggctggatggctgttagcccagctcgccgacttattagcatcaatgatctcaattgcggcgagtttggagggatcctcgccagcctcgcgtatgccttcctccactgcctcgatgcgacgtgtcacttttattccgacaacaggactccccgtgatcacaagatatgcgccttgcctcttaatggtttcggcgagcgcctcatttagcttccgtttcttaccttttccttgggatgctttagtccagacctcctccttgaaactagaaggcccgtggtcgctcttcttgcactgaaagattgtgtaccgatgaggcagaaagtccgtcttagcggggcctttgtgccaagcaactcgaccatcctcaccaccatctgcgatggttatctgagccggggcagtacccgcgcctaggggaattccatttttcgttaactcagcgcttagtagcctacgcaggagctctactaattggagatccctgaggcgagttatctgatctgcggtcacttcaaatatattcatcgtttccaagtttctctctgggcgatatcaattccgcgactattcctacgctagacaagatttctcaaagcgacaaggaacattatccgcgccgccgccacgacttggactcaaaatggcgtttcaacaaaaaatatctaggtcggaatacagaagtaggctggatggcgctaattattctatgcagccgtgcttacagaggcagggatggagagcagcgacaatccccatagctcacggcctcaccaacctaggcaacaccccccctccaccaacctctctacccccaaccttatcctctcccccccctgctcaatcaccaccccatccccctccaccgccaccaacttcaccccaggcccaaccttctccccctgcaaaaaactcctcggcggcccatcgttcaggctcagtatcgccaccgccccccgactccccgccatcaccccgctcaccttgatgtccatcggcgccgtttgattggaaaaccactgcaacgccgggctatcactgcgcgccgctagcaactgcggggccgctgccggggtgtgggattcggcggaggtcagtagcagcgacgaccacgtcgccacgccgaccagcgccgcgagcagtgcgagggcctggaccatttgcggtggggaaacgcgtgcggtgaaggtcatgggttgaatctcctttttatccctgctgtcagcctacgcggcaattctctccgttttatttcacacgccttacatgttggccgtgcacgatggcgcaggacgcaaaggagcgcgcgcgcgatgaacaggcaagagggttttacgctgatcgagttgatggtggtgctggtgatcatcggcatcgccagtgcggcgatcagcttgagtatcaagcccgatccgttgcagttgctgcgcaaggatgccgagcgtgtggcgcagttgctgcaggtcgcgcaggccgaggcccgggcggatggccggccgattgtgtgggtgagtgatgccaaggggtttcggttcagtcggcgcagtgacagtggcaaggggtttgatcatttcgcgcaggatccgcagttgcggccgcgtgcctggcagagtccgaagatggaggtgcgggtggagccgaaacagagggttgtgctgaacgctgagtggattaatccgccgctgcaactgacgttgtcggatggcttgaatcgcttgagtgtgctgcgtgatggcagcggaaggatcagcctgcaatgaagagtcagcaagggtttacattgattgaggtgatggtcgcgattttgttgatggcggtggtgagtttgattgcctggcgggggctggacagtgtgacgcgggcggacagtcatttgcaggcgagcagtgagcagagtgacggtttgttgcgggcgctgaatcagttgcagcgggatgtggagatgcgggcggggattgagttgactgagccgaagaaggttggggtggatgatgagccgccgagcgccccgccagccctgactgtgcgcagtagcgacagtaaggggtttcggctggacattattcgcacggcggcggatcagccgggggctttgcagcgggtgcggtggtgggtcaagggtgacacgctgtatcgggcggtggctgaagcgcgcagtcggtatccgttgccggcgcctgggaatggggttgctgttttgagtgatgtcagtgatgtgcaggtgcgggtttgggagttggataaggggtggcggcagttgagcgggaatcggcgggaggatccgctggggttggagattcggttgagtcgggggacggcgcagggggtggagaagtatcggcaggtgattgggccgttggagtgatactggctgcaatgtggatatccgtgtaggagctgccgaaggctgcgatcttttgactttgattttgcagatcaaaagatcgcagccttcggcagctcctacattgggattgggggtcgtcagttggggattggttggctgtgaggccgtcatcgcgagcaggctcactcctacaattggattgggggcagtcagttgggggttggttggctgtgaggtcgtcatcgcgagcaggctcactcctacagttggatcgagtacatcagcaatgagattggttggctggtaggccgccatcgctgacaagccagctcccacagggattgggggcagtcagttggggattggttggctgtgaggtcgtcatcgcgagcaggctcactcctacagttggatcgggtacatcagcaagagattggttggctggaaggccgccttcgcgagcaggctcgctcctacagtttttaatgtgcgtacagcccagcggcaaagccgccccactcaacaggatgagcgttagctcggctgccgctcttgatcttgatccacgggcgacgtcggaaggctgagtggagggattcatccgggggtgggagcgcagcgaccgtttggcgcagccaaatgcatcgagaggaggtgcagcgaagcaaaccgtaggcgatgcgcccggatggatcccggagcgaaggaaccccgagccttagcgagcgggccggacgtaggagcaagcgtttttggttacttttgaggcgtttgtcaaaagtgacccgccgtaagggcggaaccctaagccgccgttaccgcagcaacggatatgcacccaatcaaccccactaactcaaaacaacgacgccacccggcaactcggtgcacttaacgccataagcatcccgaatcagcagcgcaacaccagcaagttggtcaaggctaaagcgcgcctgcacccggcgctgcccaagctcacggttgagcaacaacaacatccccggccgatagcggttgatctcgtcgatcatctgactcagcgtggcgccgttaaacaccaacacttgctgacgccaattcatcaccgccgccgtgtcgacactctgcacactgccaacctgccgcgcgtcgtaagtcacctgctgccccgactcaagacgcagactacgcccctcaacatccacttcaaccgcaccatcaaggcaagtcacacagacttgctgatcagtgttgcgcaagttgaaccgcccctgactggcccgcaaccaccctcccccagcctgcatcgccaacggcaaccgcgcggtctgcacttcaacttcaccactgaccagctcaaaaccctgcacaccgtcagacattgcacgctgattgatccgcgtctgagtattcagctccaggctaacaccctgcacaggttcaaaacgccgctgctggccaacttcagtaatgtagtcagcgcccaacccttcgaaaccaccaggaatcgtcccgcgcaccagcaaaaacgccgccgacgcagcaatcgccccaccgagaaaagcacgtcgaccaaacccgcgtggcgcctgcatttgctccacggccggttgcaggttgtgccacaaccgcttggcctcttcgaacgcgcgggcatgctcggcactccgggcgcaccattcacgcaaggcgcgggcgtcggccacggtggcgcggccggaggtcagcaggaccagccagtcgcgggcttcgctgtgcagattgtcggccgccgatggctcggcaggtgtcagtcgaaagatgttcaaacgcgcagattctcaacgaattgatcgggcactattcagaagacggttttccggccccacgaccgaaccgctgaaacacttttctttccagtttcgccgcgcagaagcccaacgcggctttgatttccttctcaaccatgcgcgtggaaataccgaaacgctgggaaatttccaggtgcggtgcctcttccagacgcgccgcgatgaagatcttccggcgccgtgcgggcagctcgtacaacgcactgagcagcgactggatttccttttgcccgcccactactcgcgcgggatcgagggcttcgtcgccgatttgcagcagctcttcgacttcctcgccggtgagcaggcgcgcatcggcctggcggcggtcggcggcgatgttcagagccatgcgatagaggtaggcattcggccgcaggacgttcggcggcgtctccatgcgatcgacccgcaggtaggtttcgtgcagcacgtcgttggccagatcttccgaaccgagacgcctgcgcaggcgcacccgaaagtcctcgtaggacgtcaggaacagttggaccatcgaaccttgtccggtgttgtctttcatcccccggaaactccttcccatttggtgcattccatgcgtttccctgacgactccggtaacaacagcaacgtgaccggctgacgcaaagcgctgggcgtcggtcggtcgatcttgagattgcgaaaactttccaccagcgcggtgtcgcgccgtacatcaccggtcgaagtgaccaaccggttgtgctgcaccaagccgtcgcggccgacccagacctgcaacaccgcgcgataactgcccggccgggtcagcggcgagcggcacagattgcgctcgatcgccgcttgcacggccgtggcgtaactgcggttgaccgcgacgctttccggcgtctgtttttgcgatggtgccggtacgtcttcgacctgcgccacttgcaacgtaaacgcatcgtcgcgggcataccgcgccatcaaaccactgccgccgagcagtcgacgcagggcatcggcggcggtgtattcaccgtccaccgcgagcgagcgacgaccgcgactcaactgactgtcgaccagcaccgcaacgcccgtggcgtggctgtactgatccagcgcgcgggccagatcctgtgccggaatgtgcagcgtcatgcgcaggtccgccggcaccgcatcggccatggcatggcccgccgcacagccaagcagccaccccagacacatccggcgcacaagcctcgttgaacgctgaaaaccgtccgtggaattgcctcgctgcacggctgacgaatccttggaaatcgtcatcctgagggctgtttatgaatctggtgtgacgggcggtgcaaaaaaaccatcacgggaattgcgcacggcttgcactagactcaagccaaagcgcggccccatcgggccggccaggaggcgagcatgaacacactgtggcgattaagccttggcgggctgatgttgatggcgctgtcgagcgcctatgccgagcagccattgggctgtgtcgaggtgacggttggcggttacaaggcgccgaattacgattgtctgagccagcagatgggcaataacccggaaggcgctgcggcggcggagaagaatcaagaggcgctgaatgtgccgttgaacaagcggccgccgaatcaggttggcctcgcgacgccggcggcgaccagtacgcggatgggcaatacctttggcacctcggtgaaaccgcaacgcccaccgcaatgacacgccaccgatcgttcccacgctccgcgtgggaatgcagcccgggacgctccgcgtcccatcccgaacatgtgtccaccatgtctccggtacatacagggagagggctagggtgagggccttctaactgactcgccgctcaatcccatgcttacgcagcttcctgtaaagagtgttgcggctgacccccagttgctgcgccgtatgggtcatgtgccagcgagtttgctccagcacattgagcagagccgaccgctcggcatcttccagcggatgatcggattcatccaccgctcgtactgccggactcccctgccgaatcatcaccggcaaatcctcaatcccgatccgcccttcatcacacaacgccgccaatgtacgcagcacattgcgcaactgccgcacattgcccggccagttgaatgccagcaacgcctgacgtgccgcctcgtcgatcatgatcgtgtcgccgcccgcctcttcagccagcaaaaaatccagcaattgcgatttatcactgcgcgcgcgtagcgcaggcagtgccacttccagcccgttgagccggtaatacagatcttcgcggaagctgccatcggcgacccgctccagcagattgcggtgggtagcgctgatgatccgcacgttgaccgcttccggttcgccaccgatcggcaccacttgtcgatcctccagcacccgcaacaaccgtgtctgcaaggccagcggcatgtcaccgatttcatcgaggaacaaagtgccgccatcggcctgctgcaacttgccgcgcatgccgtccttgcgtgcgccagtaaaactgccaccgcgatagccgaataattcgctctcgatcaggctttcaggaatggccgcgcaattgagagcgacgaaggctttgctcgagcgctggctggcctgatgcacagccttggcgaacgcttctttgcccgagccggtttcgccattgaccaatagcggcacgtcccgttcgaacacccgcagggctttgcggaaatcggcttgcagcgcggcgtctcccagacagatcccggacagtcgtggcgctgctattggttttgccgcctgcatgagcggcgtcggtttacgcgactcaccgcgcaacaccgcgaacagatgccggccgtcgcgggtgtgcagcggccaactggcgctggcattggcgctggcgcgaccgagcagttcatccagcgagcaatcgaagaacgcttcgaccggtttaccgagcaatcctccgcgaatatgcccgagcaggttcagtgcactctgattgaccgcactgatccgcccctccccgtcaaacgccagcaagccttcgctgaacagcccgaccgactcggcctgcaagtggaaacgcagcagccattggttatcgaaacagcgcaggaagtagcagctctcgatcatcttcgccgacagattgaccagcgccatggtgtggaactggctctgccgcgagacgtcgtggcgggccgaggacacgtcgaggaccgcgagcaattcaccgtgtgggtcgaacaccgggctcgccgaacaggtcaggccggtatgacggccgcgaaagtgttcatcctgatgaatcgtcagcgcctgacgctcgaccagacaagtgccgatgccattggtgccttcgcaggcctcgctccagtcagcgccgagccacaaaccggcgcgctcgaagatcttgcgctcggcgggtgcggtgacgcagttgaggatcaccccgcgcgcgtcggtcagcagcaccgcgtggccggcgccggagagctgttgatgcaggctgctcatttcgttgccggcaatctgcagaacctgttgcagacgttcgcggctttccagtacccggccatgttcgagcacggtcggcgccatgctcagcgccgggtcgaggtgatagtcctcaaggcagcgaagccaggagcgcgcaatcgacgggtcggcgccgggcccgtgcaggtgcggtttgccctgcgtagcagtgagaacctgttgggcatggcgactcaaatggttgtcgtgcatttcttatttttctccatattccccgtgtaggagctgccgaaggctgcgatcttttgatcttgtatttttgaagatcaagatcaaaagatcgcagcccgcggcagctcctacaggggttgctgttggctgagcatcctccagctcaagcaccattgcaatgctggcaagactgcccggtcacacgctgtggcaaaagcggtacaaactgtcactccaactgtaccgaaaccgtcacaggcacaatccgctcgtccgacaaaaaccacgcaacaccttgatttacctgacctgcacggcagtggcccgacctttgctctacgcttatagcaagcgcacttgcgcgtttctctaataagtacaaagccaaggagaacatcatcatgcgttacgctcaccccggtactgaaggcgccaaagtttcgttcaaagccaagtacggtaactacatcggcggcgagttcgtcgcgcctgtcaaaggtcagtacttcaccaacacctcgccagtgaatggccaaccgattgccgaattcccgcgttcaactgccgaagacatcgataaggcactggacgccgcccacgccgcagccgacgcgtggggcgcgacctccgtgcaggcgcgctcgctgatcctgctgaaaatcgccgaccgcatcgaacagaacctcgaactgctggcgatcaccgaaacctgggacaacggcaaagccatccgcgaaaccctcaacgctgacatcccgctcgccgccgaccacttccgctactacgccgggtgcatccgtgcccaagaaggcagcgctgccgaaatcgacggcaacaccgtggcctatcacattcacgaaccactgggcgtggtcggtcagatcatcccgtggaacttcccgatcctgatggccgcgtggaaactggcgccagccctggcagcgggtaactgcgtggtgctcaagcctgccgagcagactccgctgggtatttccgtgctggtcgaactgatcggcgatctgctgccaccgggcgtgctgaacattgttcagggttacggcaaagaagccggcgaagccctggccaccagcaaacgcatcgctaaaatcgccttcactggctcgaccccggtcggctcgcacatcatgaaatgcgccgccgagaacatcattccgtccaccgtggaactgggcggcaagtcgccgaacatcttcttcgaagacatcatgcaggccgaaccgacctttatcgaaaaggccgctgaaggtctggtgctggcgttcttcaaccagggcgaagtctgcacctgcccttcccgcgcattggtgcaggaatcgatctacgacgagttcatggccgtcgtcatgaagaaggtcctgcaaatcaaacgcggcgatccgctggacaccgacaccatggtcggcgcgcaggcgtccgagcagcaattcgacaagattctttcgtatctggaaatcgccaagggcgaaggcgccgagctgctgactggcggcaaggtagaaaaactcgagggcaacctgtcgaccggctattacatccagccgaccctgctcaagggcaccaacaagatgcgcgtgttccaggaagaaatcttcggcccggtggtgagcatcaccaccttcaaggacgaagccgaagccctggcgattgccaacgacaccgaattcggcctcggcgccggcctgtggacccgcgacatcaaccgcgcctaccgcatgggccgggcgatcaaggccgggcgcgtgtggaccaactgctaccacctgtatccggcgcatgccgcgtttggtggttacaagaagtccggcgttggccgtgagacgcacaagatgatgctcgatcactaccagcagacgaaaaacctgctggtgagctacgacatcaatccgttgggcttcttctaaacctgcagcactgatcgttcccacgctctgcgtgggaatgccgcccgggacgctccgcgtcccgccaaagccgaacgcagagcgtccgttgaggcatccccacgcagagcgtggggacgatcatgctacccaccggcaaaaaagccgggccaataaaacaataagaacggtgaaccctatgcctagcgaatccccggctggcgctccggcgtccggcgcttctgtcgacttcgaaaaagtcggatcggattactttcaacaacgcgaactgaaaaaaggcgccgccggctgggttctgctggtgggtctgggcgttgcctatgtcatttccggtgactacgccggctggaacttcggtctcgcacaaggcggctggggcggtatgtttctggcgacgctgctgatggccaccatgtacctgtgcatgtgcttttctctggccgagttgtcttcgatgatccccaccgccggcggtggctacggttttgcgcgcagtgctttcgggccgtggggcgggtttctcaccggcaccgcgatcctcatcgagtacgccattgccccagcggccatcgcggtgtttatcggcgcttactgcgagtcgctattcggcatcggcggctggatgatctatctggccttctacatcattttcattgccatccacattttcggcgtcggcgaggcgctcaagctgatgttcgtcattacggccattgccgcgctggcgctgggggtatttctggtggcgatggttccgcacttcgacgtcgccaacctgctcgacattccggtcaccgccgcagcgggcgccagtccgtttctgccattcggctatgtcggcgtctgggcagcgatcccctatgcgatctggttctttcttgccgttgaaggtgtgccgctggcagcagaagaaaccaagaaccccaagcgtgacctgccgcgcggtctgatcggcgccatgttggtgctgctcatgtttgcccttttgattctgatcgtcggccctggcggtgcaggcgccaactcgctgctgacctctggcaacccgttggtcgaagcgttgagcaaggcttatggcggctcgacctggatgggcagtttcgtcaatctcgtgggccttgccggcttgatcgcgagtttcttctcgatcatttatgcctactcgcgacagattttcgcgctgtcgcgggccggctacctgccacgcaaactgtccgaaaccaataagagcaaggcaccggtcctggcgctggtgattcccggcatcatcggtttcggcctgtcgctgaccggtcagggcgatctgctgattctagtggcggtgttcggcgcaaccatttcctacgtgctgatgatggccgcgcacatcactttgcggattcgccgccccaaaatggaccggccgtaccgcacaccgggcggcatcttcacctccggcgtggccttggtgctggcgtgcattgccgtggtggcgggcttcctggtcgatccacgggtggtaattggtgccgccgtcatctatggagtgttaattgcttactttgcgttctacagtcgacatcacttggtagcaggcacgccggaagaagaattcgcggcgatccagaaggctgagcaagccttgcactgagtgctgacaatcccggcgcaggctcggtctgcgccgtcacggagaattgtgtatggccagtttcgcccacacggtcggcgcccagacctatcgtttcgacagcctcaaagacgtcatggccaaggccagcccggcgcgctccggcgacttcctcgccggcgtcgcggcgctcaacgacggcgagcgggtggccgcgcaaatggcgctggccgacatcccgctcacgcacttcctgcaggaagcgctgattccctacgagtccgatgaagtcacccggctgatcatcgacactcacgataaacaagcctttgccgtagtcagccacctcactgtcggtggtttccgcgactggctgctcagcgacgccgccgacgaaaacagcctgcgcgccctcgcccccggcctgaccccggaaatggtcgccgccgtgtcaaagatcatgcgcgtgcaggatctggtgctggtggcgcaaaagattcgcgtggtgacgaagtttcgcggcaccctcggcctgcgcgggcgcctgtcgacgcgcctgcaacccaatcatccaaccgacgagccgtccggcattgccgcaagcattctcgacggcctgctctacggcaatggcgacgcgatgatcggcatcaacccggccaccgacagcatcgcctcgatctgcgccatgctggagatgctcgacgcaatcatccagcgctacgacatcccgacccaggcctgcgtgctgacgcacgtcaccacctccatcgaggcgatcaatcgtggcgtgccgctggacctggtgttccagtcgattgccggcaccgaagccgccaacgccagtttcggcatcaacctcaacgtattgcaggaaggctacgacgccggcctgagcctgaatcgcggcacgcttgggcagaatctgatgtatttcgaaaccggtcagggcagtgcactgtcggccaacgcccaccacggtgtcgaccaacagacctgcgaaacccgagcctacgccgtggcgcgacatttcaaaccgttcctggtcaacaccgtcgtaggatttatcggcccggaatacctctataacggcaagcagatcatccgcgccggcctcgaagaccatttttgcggcaagttgctcggcgtgccgatgggctgcgacatctgctacaccaaccacgccgaagccgatcaggacgacatggacaccctgctgaccctcttgggtgttgccgggatcaacttcatcatgggcatccccggctccgacgacatcatgctcaactaccagaccacgtcgttccacgacgcgctttacgcgcgccagaccctgggcctgaaaccggcgccggagttcgagcaatggctggcgaacatgggtattttcacgcaagcggatggcaaggttcgcttcggtaacaacttgccgccggccttccgccaggctctggcgcaactgggatgagtcgtatggataaaccgcccgtggacccacaaaacccttggctggaactgcgccgcctgacgcccgcgcgcatcgctctgggccgcactggcaccagcctgccgaccagcgcgcaactggatttccagttcgcccacgcccaagcgcgcgatgctgtgcacttgccattcgatcacgccgggctcagcgcgcaactgactgagcgcgggcgtgagagcctgctgctgcacagcgccgctgtggaccgcaacagctatctgcaacgcccggatctggggcgcaaactgagcgatgactcggcccagcacttgcgtgattacgcggccgcgcatccgggcggcgtcgatctggcaattgtcgtggctgacggcttgtcggcgctggcggttcaccggcataccttgccatttatcacgcgactggaagaacagatgggcggcgatggctggtcactcgcgcccgtcgtgctggtggaacagggccgcgtcgcggtcggcgatgaaatcggccagttgctcggcgcaaaaatgctggtgatgctgatcggcgagcgtcctggcctcagctcgccggacagcctcggtttatatttcacctacaatccaaaagtcggactgaccgatgcctaccgcaattgcatctccaacgtgcggctcgaaggcttgagctacggcatggcggcgcatcgcttgttgtatctgatgcgtgaggcctgtcggcgacagttgtcgggggtcaacctcaaggacgaagcacaggttcagacgctggaatcggacgccggtgtagacatgaaaggcaatttcctactcgatccgccctcaacctgaaccgtttccgcattgcgtttctgcgccggtttcaggcaggatcgatgcacggccgcccgggtttcccatcgccgtcagagcagtcgaagacagccacttgaagacgagacctatcatgcggattattcaagcgaccctcgaacatctggatttgttgactccgttgttcgtcaagtatcgcgagttctacggttccctgccttatccggactcctcccgcgccttcctcgaaaaacgcctgcggcgcaaggaatcggtgatctatctggcgctggccgatgatgacgacaagaaactgatgggcttctgccagctctacccaagtttttcatcgttatcgctcaaacgcgtgtggatcctcaatgacatctatgtcgccgaagacgcgcgccgccaactggtcgccgacaacctgatccgcactgcgaagaaaatggccaaggaaacccaggccgtgcgcatgcgcgtctccaccagcagcaacaacgaagtggcgcagaaaacctacgaatccatcgggttcaaggaagacaccgagttcaagaactatgtgctgccgatcagcgacgaactctgatcgcggatacaacctgtgatgagggagcccgctccctcagaaacgcaaaacgcgtccctgacaattgttcacacctcgacatccctcgctacaaaaccaacgcgcttttcatccttcagaccgtataatcccgatctttccggcttgtaagaaaaactacacccgcttgtaggcttacacgaagtcatccgcacaggcctgccgagtccggccgtcaaacaggtgcccccatggatttcaacccgctcgaccttatcctgcatctcgacgtgtacctcgatttgctggtgaacaactatgggccatggatctacgccatcctgtttctggtgatcttctgtgaaaccggtctggtggtgatgccgttcctgcctggcgattcgctgttgttcattgccggcgccgtggcggcgggcggtggtatggaccccgtgctactgggcggcttgctgatgctggcggcgatcatgggagacagtaccaactacgtgatcggacgaacggcgggagaaaaactgttcagcaatcccaattcgaaaatcttccgtcgcgactacctgcaaaaaacccacgatttctatgacaagcacggcggcaagaccgtgaccctggcgcgctttctgccgatcatccgtacctttgcgccgttcgtcgccggtgtggcgcgtatgccgtacccacgctttttcggcttcagcgtgctcggcaccatcctctgggttggcggtctggtgacgctgggctacttcttcggcaatgtaccgttcatcaagaaaaacctgtcgttgctggtcgtggcaatcattctgctatcgctggtgccaatgatccttggcgtggttcgcggccgtttcggcggcagcaaagccgaatcgcactaagcaatgtggtcgctgagcgcctggcgtcgccggcgcatcctggcgaaacacccgattgccgacgacatgtggcaacgggtgcgccatcacctgagctttctcgacggcatcactgccgcgcaagaccagtggctgcgcgaagcctgcgtgctgttcctcgaagaaaaacacctcagcgccctgcccggcgtcgagctgcaccaggagcaacgcctgttgcttgcagcccaggcgcaattgccgctgctcaatctcggtgatttgaactggtatcagggtttccacgaaatcgtcctctatcccgatgacttcctcagcccgcagcgccaccgcgatgccagcggtgtcgagcacgagtgggacggcgaacacagcggcgaggcctggcaacagggcccgatcattctcgcctggcccggcgtcatggccagtggtggctgggaaggctacaacctggtgatccacgaactggcgcacaaactcgacatgctcaacggcgacgccaacggcctgccgccgctgcatgccgacatgcgcgtgagcgactgggccgaggtcatgcaacaggcctacgacgacctcaaccgccagctcgatcgcaaccccgacgccgaaaccgccattgatccctacgctgccgagaacccggcggaattctttgcggtcaccagcgagtatttcttcagcgccccggatctgctgcacgaggcttatccacaggtctatgcgcagttgcagcttttctaccgccaggacccgttgagccgattgcggcaacttcaggccacaggcccggtctatcaggcgcacgactaagctctgcacgactttcggtacatggcgtcgacggcagaatatgcctataatcgccgccactttttggtcaatccggccaagtgtttttggtcaactacgggggcaacgcccaatgagctacagcaagattccggctggcaaagacctgccgaacgacatctacgtcgcgatcgagatcccggccaaccacgcgccgatcaaatacgaaatcgacaaagacagcgattgcctgttcgttgaccgtttcatggccaccccaatgttctacccggccaactacggttacatcccgaacaccctggctgacgacggtgatcccctcgacgtgctggttgtgaccccttacccggtcgcgccaggctcggtgatccgcgcacgtccggtcggtatcctgaacatgaccgacgacggcggcggcgatgccaaagtcatcgcagtgccacacgacaagctgtcccagctgtacgtcgacgtgaaggaatacaccgacctgccgccactgctgatccagcagatcgagcacttcttcgcgaactacaaagatctcgaaaaaggcaaatgggtcaagatcgaaggctgggccggtgcagacgccgcccgcgaagcgatcaccaagtcggttgccgcctacaaaggctaagcacctgcgctacgcgtgatgcttgaagaaaaccccggttgatccggggttttttgtgcgcgagaacatgcacgttaaacggctcgtttaaaatctgaacgacgcagttttaacctgtttaatttcctacaagaatgccttacatcccgtcgcaaaattcaccccgcttttgaacgccaggtttattcaaaccgctctggcacggccgtagactctgtgtttatgagaaagaacactagcggtccaagattcaaggcactcctggaagcagcgaacatcaccaccacgggtttcgcaaagttctggggcacggaagcccaaaatgtccacaactggtacacccggggcgtcccggcgtatcgcatggaagaagtctcacgcctgctgtccgtcaacagcgaatggctgaaaaccggtgaaggcagcaaagagtcgccaagcctcaatgcacccgccagcaacggcgacaccttcgacgcccacgccatctgcggcgtctacaccgtaatcgaccccaacgacatcgacctggtgttcttcaaggaaaccccgcttagcaacggctccggcaaaacccatgtcattcaggacccggatcaatccatccgcctgctccgcgcccagctcgatcaattggaagtcagacactcagacgccatctgcgcgcaaatgatcggcaacagcatggccgagcgcatcgaagacggctccattgtcgccatcgaccgcggcctgactcaggtcgtcgacggcgaaatctacgccatcgaacacgacggcatgctgcgcatcaaatacctgcaccgcatgcccggcaacggcttgcgactgcgcagccacaacagcgccgaatacccggacgaagtgttccgcccagcgcagatcgaggagcaaaggattcatatattgggctgggtgttctggtggtcgacggtgagcaagcgccggccggtggtgccgtttctttgacctgatgcgtttttttcgaatctgcactgaaccctgtgggagcgagcctgctcgcgaagaggcccggacaaacggtacaaattccggatttgtggcgcagaagtcgctctaacccgcacttcaggctgggaatcccaagcaaaactcagtatcctgcgccccacatttgcgcatcgacccgccccgcggctcagagagcgcccgacgcggcagaccaacgtctgaccaagtcccacagccggacgcagatccggatgtacgttttgaaggctggcaaggcttaccaaaaataggccaagccagtccccgagaagccggccacaagccggctttttaatgcctgcaaaaaaacacgtttaccttggcgagcttgactcaacacttgccaaccctaaccccctcagtgctaaatcctgcccaacacccaacccctctgtttttacccgcatccccgaccccggccggattccggtattgagcctcacgggaatccatggaatggccctgcatatcccgaccctgctggtcgtttccgtcttcgtcttctttttgatggggctgttgacgctgcacgcctggtatcgcgaaacccgcgaaccgccgctggcctacctcggcagcatgatgctgttgggcgcgctgggcgtggtgctggtgagttggcgggatcgcggggtggatttcgttccgatcatcttcggcaacattgttctgttgctcagcgccgcgatgaactggacggccatgcgcacgctgacgggtcgccaaccttacctgccaggcattttggcgggttctgtggtctggctgctgttgtgcctgatacccgccttttacgactcgatggcgaatcgagtactgatctactctctcctggcattcgggtatggcgtgctgacgacattggaactctggcgcaaccgtcacagcctggacgtcgcgttcatgccggcgttggtgctgaccgttttgcacaccattttctatgcggtgcgcagcgcgaccgatgacgggctgccggtgaccaaggcgttgctgggcagtggcgaaggcgtgccgtttttctcattcatgctcttcgagtcgatgttgtatgtcatcggcattgcctacatcaccttggcgatggtcaaggaacgcgccgaactcaagctcaaggccgcggcgctcagcgatccgttgaccggcatcggcaatcgtcgcgcgttcatgcagcacggcagtcacttgctggacggctgtcagcagcgggccgaaccggcggcgttgctcctttgcgatctggatcacttcaagcgtttgaacgacacctacggccatcctgtcggcgatcaagcgttgatcgcgttcagcgaagtcctgatggaaagcgtgcgcaaagaggatgtattcgggcgcatcggtggcgaggagtttgcctgtctgctctgcgcatgcgatgagccgactgctctggagactgccgagcgaatccgtcattccttcgccggactctccattctggaaccggggctgctcagcgtcagtatcggcgtggtcaccacccgtgaatcgggttacgacctgtcgcgtctgctttcggaggcggatcaggcgctgtacggcgccaagcatcagggccgcaaccgggttcaaacgttgcgctcgttgtttctgggtctggcgtaaaaacccttttgaagtagccgtccgacgcagttggccgggctgtaaatccgagaaacgctccacaaggaagttagacattgaatctccgcaggctgaactcacagctgaaatccgttgccgcaaccaccctgtgcctctgcttgaccgggtgtgtcggagtaggcatctccctcccagaaaaagtcacactgaaaaccgacgcctaccgagcgcaaagttaccgctcaatcaccccacaaatcacccgaacagcaacatcgacgcccacccgcgaatggtgcggaatcactgtctgggcgctggtgattccggtgccgttgaagctgccggtttgccactcgtactccgagcaatccttcggcagtgacgagttcgggagggagaccgttctgctcaacacccgacaatcagtgccatccccgctctacgcctgtggcccactcatggtgctggggccgatcgttcacggttacgaaggtaatgcgctgtgcggtgtttttcctgactgatccgttgattcacggataactgaacgacttcaccaacgtcaactcccccaccgcccgcatcggcaccacaaacgtctccatcttctcgctcggcgtgccttcttcagtaatcaccgtcacttgcgccgtggtcagcggctgcaccggttcatctccaccctcgtcatccccgcgatagccaccgccgtagtaattcacatacaccagatactggcccttgatcggtgccggcatggcgaagatttccgggccgtagccggtggtgacgtcgacgtcgagcgcggcgccgttaggtgcggtgcggttgccgtaccagatgtgcgcgccgtcaggggtgacgaggtgcaggtcgaggtcggtgccatcgctgtcccacgccagcagtacgcgcagttttgccggggtggcaccgccgctggtgttgagaaattgcgtgcgatgacgttgctggccgtcgggactgcgcacttcgacgctgttgctgccgttggggaaggagaacgggcggtcaaagcggccgctgtcgtcgattttcagcggcatgctcacgccgttgacgatcaggcgaccgggttcgttgtccttccgcgcagctttgatctcgccgctgatgcgtgcggtgttggcttggcccaccggggtattgaccgacgaggccgggtagttgacggtctggcggaagctttcgccctcgccttcgggcgcaccgctgcgccagccgccgaccggggtgtcgagtttgacgctgtcggcggcgatggccggcgatagcgcggtcaatgtgcagagcagcagcaagacctgtggatagcggagtgtcatggtctattccagcaaaaggtgacgggcgagcccttcgatgtaggtttcatcctggccgttgggatgtgcttcaaaggccagatgcagatattcgtgggtcaggtcgaggcgatcctgcagggtcagtacgccacgcacgtaaatacgttggcgttcgcgatcaacgaagggccgaccgaaggcgagtttgcacacggcgaaggtgctgacttcgttgtagccggtttcgctttccagtgtcggacgccagccgcgacgttgtttttgcagccagtcttgcgcggcgggcagcgcttcgcaggaagcaaccgggttgtcccaacggctgaggctggcacgcggataggcgtgcagcagaatggcgtcgtaacgctgtccggcattggcttgctcgacagcttgttgccaggcgagtttgtccgggccgggctggtcggagtgataggtgaccgtactgccggccaaaaccaggtccgccgtccatgcggcgatgttgcgggattcggccgaggccgggcgcggtgcgacgcgttggcggttgctgctgtcatcgatactcaggcaatcgccgttacgtgtagcgttttgcagcaggtacgtgcggatcgctacggccaacgccttggcggcttcggcgggttcaggtttggcttcacgttccagcacgcgggcgacgtattcttcgcgttcaagccttgcgacgagtttgtcgttgagcagaaacagttcgccgtcgctgtggatatccagcgcgttgccattggcgaattcgacgcggtaatcgccttgcaacgggccggaagtcaccacccgctcgccagtcagaacccgggaaaccggatagcgcgagaacaatccgacttcaacacatcgtcccgcttctgccggccatgccgctggcaaaacggtcgccaacgcctggccgtaatggcgcaagaccatctgactggtgccacgcccgccagcccagagcggcgagccgtccgccgtccaaccggcgaaaccaccctgccgcgattgcgggtcctgatcgccgagccagctccaggtcttcacccgcaggcgcccgcccagttcaccgacgacattgccgtccgccgcattcagcaccacatcgagcaacacccgccgcgcctgatcctgtgccggcaacgaggccaggaccttcagcagttcaaccaaggaaacccgttgagccggttgcaccgacggcaaatccagcaaccacgacggcgcctgccgcgcctgccaataggtccgccaatccgtcgccgtaatgcccaatcgcgcaggctcgaaatacaacccgcaggatttcaccagcgcctgatcacgctcgatcctgccgcccgccgagcagcaataaacctcttccttcgactgtccgcgacattcatatgccggctcccgtgcgccggtgtccaccagccacgcgtagacaaacagcttccacaggctgcccagcggcgtatccagcgatgacggcaacggttcacgagcgatcagttgtgtctgattcagcgacaacaactcgcccttataggccacgcgcaacggttcatcctgcgccgtcgccagcgcagggatcacacacatcagcagccacagcagcggccggctcatgtcagttgaccgtgacctgaccgagggcggctttcgcttcctgggcctgatgttgcggcgcgtaaacctgcttgaaacgcaccggcggcagattgaactggcccttctgcgagaagcgcaccagatggcgcaggcgcaactcgccgctcaacgcatcgaccggcaccgcgtaagccagttgtcccggttcgaagcgcgccttctccagcgcagtcggctcggtgccgtccttgccctgcaacttgataccccacgtggtgcgctcgacatcggcacccggtggcagcggcacttcgagcatgccgtagcgcagcggtttcggcgctttgctggtgaggatcacttcgtccagatacaggctgtcgctggacagcggcttggtgccgaccggctccagtttgaaggtgaacgcttcatcgcccggcaccagtcgcgacaggcgacgggtgatggtcacggccattggatcgagcgctggttgctgggtctggaagctcagcgccgcgcgcagcggacgctcttgcgtgccggacaccgtcaatacgctcgggaccggcgtcgcgccctgccacgtccagtacatctcaccggttgctccgtagtttttcttccagccttcacccggcgtcaatgcgatggtcggcgaagcctgggcgatgctgcgttgcagccaggtcagcgccagcgcacgttcgagggtcgattgctgtggcagcagacgttgcaacaacgccgtcgcacgtgcctgatcgaacgcttgcagcgacaggttcagcgcttcggcaaacggctgcgagctgaccgccaaacgttgttgcgcagaagccaactgacgattgaatgcatctggcaaggccactttcgactgcgaggccagcgctgcggtcaacacccgcgccgctgccagaccgagcgccgagtccggatcgctcatcaccagactgtcttcgccatcgtcgagcatggtttgcgcattgccttcaccggccttggccagatcgtccatcaaaccgctgagcagtgtgttcaccggcaaatgcatctgcttggcgaacgacagaatcagcgcccgctgcagcaacggcgtgttcggcgcctgcttggcatacacctccagcacgcgctgccagtgctccggcggcaaggtcagttccagcacttggctggcgttaaagtcggcgtaataggcgtaagcggtgaggaacgcatccggctcaccgtcgtaaccccaccaggtgaagctcgccgacggcccggccatttgcaccagacgcagacggctgttctgcatgatcagccgcaagcgatcgcggatctgcggattcgacgccagtgatggataggcgatgctcaacggcagcaaacggctggcggtttgctcgacgccgccatacggatagctgagcagatcatcgagggccgaacggaacagcgcttgcgggctgtcatccagacgcaggtgaatatccgtggcgtcgggcggcagactcaacggcgtgtcaccactggcgacatcgaggctttgcgtctgcgtcacttgccagccgtcaccggtcgcactcaggcgcacggcgagggaatcggcagttttgccatcctgcaccaactccgccgtccactcgccggaagccaatgtgaacgccggcagcggcaggtaattgatgccgttgttgagggtcaccgggacacgttgttcagcgccagcgtagtgggtcacgagttcagccttgaccggtttctcggcctgactgaacgcgaacacaccgagttgcggctgatcgcccttacggaatttgctcggcccgctccacttcaggtacagcggtttttccgaacgcacgaactgcttcttctgcccgacctgcccatcatcggcgatcgcgcgggcggtgatgcgccagcgggtcagcgagtccggcatcttgaaggtgaagcgggttttgccgtcggctccggtcaacaactctggctgccacgccgcagtatcgacgtcttcacgacgcggtcgctccagtactttcaccccgcgctcgctgcggttggctttgcccggtgcgcctgggctgcccggcaacgcgacgtcgtagctgatgaacgacagactggcgctggtgcgcacgttgttgcggcgcgggtgatagaagaactggtcgatggtcggcgcgacttccggttgcagcgcgtagaccatttcgtctacgacgctgacagtcagatgcgccggaacggctttgccggcgaactgcgtgatcaggtcaaccgtgacggtatcgcccggcagatacaccgctttgtcggtgctgatcgccacgtcgatttgcggcgcgatcactttgatcccggcgttctggaagctgtactgaccgcccttggtgtagagcacggagaaggtcaggttcggcgcgaagttgtccttcaccgggatgcgcgcgcggtattgagtgtcgctgagcttttccagtttcagccagtcgccgcccttggccagcagcgcagtggcttcgaccttgtcacgctccagcgacaacagcgcatcgctgaccggttcggggaaagtgatcagcgccagcgcttcatcgccggccttgtactcaggtttatcgaggacgatttccacggtgcccggcactgctttgacgccgtcgccagtgaccgaatgcccggtggcaccgagcacgcgaccgtgttgatctttcaaggtcaggttgtaagtacccggacgatcaaacgccagactgaagcccttgtccgtcgccgcaagtttgccttcaccggtgctctggtcttccaggcgcacccagccataggtgctcggcgtcaccgctttgctttgctcggtgccgccttcgttgacgtagctgaacgcaaccttgtcgccgaccgcgctgaagcgttgcggtgcattcagacggaagcttgcggcgccacggtcgatgaggatttccttggtggtcttgacccgataggccgcgccatcgctggcaaacacggtgagcatgtagcggctcggtttatcggcggccggcagatcaagggtcgcgttgcctttgctgtcggtagtcagttcggtgctggtcaactccaccgggaattgccccaggtattgcagctcattgtcgaccatcgacagttgctgggcgcgcaggctcaggctcagtttggcgttggccaccggtttgccgtccgggtagagcaacaccagactgcctttgaccggttcgccggtgcggtaatcctgcttggccaggttcagcgaaatctcgaagtgcggcttgatgtactcggcgacacggaaggcgctgctgtaagcctgatccttgtagttgaagcggatctcgtaaccgcccgctaccgcgttgtccggcaactggaaacggccctgagtgccagccttcgaatcgagtttcaggtcaaggtgttgcagctcggtgccggtggcatcgagcacgctgaccgtgacatttgccgcacctggcagcaccgaatcccgcgcattcttgaattcgcgaccaacgattttcagcgacacccaatcgcccgggcgatacagcggccgatcggtgaaggcataaagtttggtgtcgtagatttcgctgtcgtaatagaagttttccgagacgaatacgccgccctcttcatcctcgccgatgacgaacgaacgctccgggctgacgtgtttcagccgcagcaagccatcagcatcggtggcaccgctgctcatcacgccgaggccatccgtccacagcacattgaccttcggcaccgagctgccttcgtgtttgcgcgcagcccagaccagcagttcatcaccggcaatcttgctcactgcgacggtgttggagacgaacaccatggtggtcgcgcggtacttgccgatcagcgcttcgaccagatacagacccggtttcagattacccaacgggatataaacgttgcccggcgcgacgctgacgaaatcgctggaagagcccgcgagattgaccccggctggcggctgaatcggcttggcctgccacaacggataacggaactggctaaccaccggcagacctggaatcaacgcaaactgcggttgcgcgtcgtacggtgtcggcgcggcgatggcgtcgcccatcttcagttccggcacttcttcggtgacctgtttgcgcgactcataggagaacgcgcgttgcatcacccgacgggatttgcggtaccagttgtcccacaggtacgcgagggtgttggacaggccctcgcccttgaactggccgtcactgaccacgcgatgcaggttcttctggcgcttgaggaagtccagcggcttgtcgatgcgatacacacgaatgtcggcgccgccataaggttccatgcggaatcgacggtaatcacggcccggcgcttcgaggcgcaccatcgcctgctcgtccgccgcgaaactgctgtcggcgagcaggaagaagctttcaccggagaccggcgtgtagccgctcggctcgaccgaatcttcggcattgacgttggccagtggcagcaacagcgccaacagcaaaggaattcgcgagcagatacgcaacatgcgggcaccggtcattgggagagaaagttcagtcgatagacgccgatgaagttggggttggctgcgtcgggtatccatcgggtgtccttccatgtcatgagttgctgcaggcttgccgaacgcatgccgttgtcagtcggggtggtgctgccggtgtgataggcgatgtagcggcccatccagatcatcaggtgctggtcgtcaccctgatcgaaaaacatcaagtccccgggccgcgcctgcgacacgtcgcggctgaccaagtggctgttgaactgaatcagtttgatcgcgttgacgtacggcccgaccttgccgccgccctgctgccattgctgggcgagcttgcgctgatcatcgctgagcgacagctctggcggcagatagcgattggacaggccattgctgcgcagccatttgtcgtcgtggactttcagcgcttcgttggcagcgaaacgcaccagcccggcacagtcctgctgataccagcgcgggctcgggccttggctcagttgctcttgggcgatacgcacgaaccaggcgcgaaacacctgggattgcgccggatccagtgcaggtgcttcaacggctcgggcgcccgcgctgagtaacagcgcgagcaggccgaggctgcggatcagtgccgtcacagcgctttccattccagcggcaaccattgccagtgaccgtcaggctcgctgccttcaggcaaggtcagggcatatttgccgtagccgccaagggtgcgcagtttcgggatcaggtaagtttgcgcggcgttatagaacaccggttccatgtcctgcggcaggctgtcgagggtttcctgctgcatcagttgcgccatcgaatccgggccgaagtagatcggcatcagcacatctttgggcagcacgtcggccatcggcgggaagcgtttgtcgagggtgccgagggccttgtcgacgagtttgtcatcgagggaaaacagcagcgtcgaaccgtggcgagcgaggctgactttcatgaaagccttgccggaaatcgcgtccggattttccgcagtcttcgccgcgtagggtccgaaattggaactgacctgacgctgccagacgtggttctggccttcctgtttctcgaccacggggaagacgttttcttcgacgttggcttcgaatgcgccgaccatcgaaccgaacagcttgccgagatcgccatcaagtttgctgctgtcctcgtctttcagactggccaccagcaacggcgtgtacaaacgcgaatcggcgtaccagcacaggcccgccgcgccggccacgtgttcggtgagggtttgcgccacagcttcttcagcgccgagcttcaccagcaatggtttttgcggttcggccgcgaccggcaaggtcacgcaggcactggcaccgagcggcatcgcctgccagaccggtttgaaatcgaagtccggctggttttccagttcgtccatggccaggtagctgtgccagcccttgtcgtccatgtcgaaacgcagcccggcgaagttcgggatgaaacgctgatagcccatcgcgagaacgctggagttgaccgacaggcgctgcttggtttccggggttttagccggcagaccgaacgcctcagggaacagtttttcgccgttgagcaacgccgccagcgcttgtggcgagacgtggcccgactcttcggagacgccgctttccgggtcgtaatacttggccggattggacagcactaccagtttgtcgccgcgggaggcgaacaacagggctttgctggcgttaaaggtcagttggtacagcggcacagtgtcgccgccgaccttgagctcgcccatctgactgagctgcgtgtcatccagcgcaacctttgccaatggctcaagcagtttcgccagaccgccacggtccatcaccagcaggaaatccttcaagcgaccatccgcgccacgccacaacgcgacgtcggccggctgatcgaaaagctcttcgatcaggctgtcctgcagtttcaggtcatgctcgtagatgatccggcgcaggctgccgatcagcccgaggcggtcggcgtgggtttcgtaatagaagacgaaatcttcggtgagcgtggctttgagaaacggcacggtcagcaagtccttgggcaactggcttagcgagcgggtttccagcaacgcatccggacggctcaggccaagcttgtcactggccaattccgccggcggtgccttgggcttgagcagcagccagccaaaaccacccgccaccccggccaccaggcacaacccggccagcaacagcggccagcgtcgcgaaggtttggccgccggcgtgtcggcagccgaagtaacagtgttatcgctcatcttctcgctcatttcccaaagctcaggatttcatccgtggcggaatgcttaatagttgaaagtcttgaccagcagcagatcaccgatcgcccgcaggggcacgatgaacgtttcgcgtttttcgtcgacggtgttttcgttgagcaccagcgtgatttgcgaggtaatgacctcgttctgattgctggtctcctcgaagttatagccgccgttgccgaagttgccccaatagttgacgtaaaccagataggtgccgtgcagcggcgcggtcatggtgaacatttccgggcccgggccatcgacgccatccgggtcgagaccgccgccattgttcaacgccggacgcgcccagaacgcatgctgaccgtcgggggtgacaatgtgcagatcgagctcggctttcggatcgtcccagcccaggacaagacgaatacgtgccggcgtgcgcaagttatttgcttcataaaattgcacgcgcttgagcgactggccctcggcgctgatcacttcaacactgttggagccggcaccgaacgcgtacggccgggcgaaacgcccttggtcgtcggtgtacagattcagtggattgccattcacagcgagactgtgcggcgggcgcatgtggccgatggctttgagctggccctggatcatcgtgcgattgcgctggacgccgcgatcgatcggcggcgtcgggtaggcgacttgcgggttttccgtgcgatcgagtaggccgtgatagcgccagccacccaccggctccgacagctcggccgtcggcgccgccagcagcgcgggcgcgcaggacaacccgatcaacagccaaagaaatgaacgcatgtaagcctcctgccatgcctgaacgaaaccttgcacccgatcctcggtacttcacagcggtgaaactgcgtttcgtctgaaagacccgtgactatggggtcgtagaaggcgcgaagattagcgattcggcggttttttaacaatcggatacatgtgcttttactgtaggaatcacgccaatccggtggacggtgagccgaatagccgtcatattcggctcacaaaatgagccgaatagcttttctattcggctcacggactcaaggcaggcaacgaatggcaactcactggatctggcagcagcccgattggcccgacttcaactggcaggcagaacgcctgacaccgttgttgcgtgagtgtgtgcaggcgcaaggtcagttgatgggtatggccggttcggtaggtgactctttgggggctcagaccgaactggacgcccttttgcagaatatcgtgacgtcttcggccatcgaaggtgagcaactgaatgtcggctccgtgcgttcatctttggcgcgacgtttgggcttggaattgatcgacggcgataaagtcagtcaacgcagtgaaggtctggcgcagcttatgctggatgtcacccgtcgatttgccgaaccgttgacgctggaacgccttctggaatggcaccaatggctgtttcccgatcaagaggctgaccttactgcacgccgcatgcatgtgggtgcactacgcggtgacgagcctatgcaggtggtatcgggtcgcattgatcgtccaacggttcatttcgaggcgccacctcgccaaggtcttgagcagcagctcgaccaatttctccaatggttcgaggccagccagcatcagacagcactcgacccgatgcttcgcgcgggcatcgcccatttctggtttgttaccttgcatccgttcgacgatggcaacggtcgcctgacccgcaccatcactgatctggcgctggcacagggcgaagcgcaagccatccgtttctacgccatgtcggcgagcattctggatgatcgttccggctactaccggattctggaatcgagccagaaagccacactggatatcactgaatggctcacatggttcctgcaaacgttgctaagcagtttgcaacaagccatcactcgaattgaaagcgtgctgggcaagacgcgtttctggcaggcacaccgtgagtccgaactttcggcggagcaggttaaagtgcttaaccgcctgctcgacggcggcgagcggggctttgagcacggcatcagtgccgggcaatatcaagcggtggcgaaagtgtcgaaggccacggcgacccgacatcttgtggagttgctggagaaaggttgcctgcaacgcttgccggggggcggtcgtagtacgcgctaccagatcaactatcccgacggagccaaacattaatctcactcaccacagtgccatttctgtccttgggaggcggcccgctcatttgcccataaaccccctatctgctagtgtcgcgccggtttaacgtcaaccggaaatcgccgccatggcccgcaaaaaagctgcactggatttcgaacagtccctcgccgacctgcaaacactggtcgagcgtctggagaacggtgaattgtcgctggaagactcgctgaccgctttcgagcagggcatcggtctgacccgtgattgccaggcagcgctggcgcaagccgagcagaaggtgcaagtgctgctggagcgcgatggcgaactcgccgaggaacccttcgacgcggaacagccagaatgattgcggcgtacacggcgaccagccagacccgggttaacgcagcgctggaaaccctgttcaatgcgccgttgccggagctggcgcggctttacgaagccatgcgctacagcgtgatgaacggcggcaaacgcgtgcgcccgctgctggcctacgccgcgtgcgaagcgctcggtggcaaggctgagcaagccaacggcgcggcttgcgcggtcgagctgatccacgcttattcgctggttcacgatgatttgccggcgatggacgacgacgatctgcgtcgcggccagccaaccacgcacaagaaattcgacgaagcctgcgcgattctcgccggtgacggtttgcagagcctggccttcagcaccctgcttgacccgcgcctgagcgattgcagcagcgacatccgcctgcaaatggtcaccgcgctggctaacgccgccggcccggcaggcatggtcggcggtcaagccatcgaccttggttcggtcggtttgaaactcgatcagaaagccctcgaacagatgcaccggcacaagaccggcgcgctgatcgaagtcagcgtcaaactcggcgctctggccagcggccgtgccgagcaggatgaactcaaggccctgcagtcatatgcacaggccatcggcctggcctttcaggtgcaggacgacatcctcgacgtcgaaagcgataccgaaaccctcggcaaacgccagggcgccgacatcgctcgtgacaaaccaacttacccggccctgctcggtctcgacgccgccaaagcctacgcgctggaactgcgtgatcaggccctgcacgccctgcgaccgtttgacgcggcagccgagcctttgcgcgagctggcccggtatatcgtcgagcgccgcagctgacggcgaatccgccaaaaaaaaccaacgcgtgggcagggggcgatgcatcaggtaaactgccgcatcttctatacctataacgattcgcctgatgcccacgacgtttcatgagattccccgcaagcgcccgaccacgcccctgctcgaccgcgcgaacacgccggacggcctgcgccggttaggcgaagccgagctggaaaccctggccgatgagttgcgcctggaactgctctacacggtcggtcagaccggtgggcatttcggtgccggcctgggcgtgatcgagctgaccatcgcgttgcattacgtcttcgacacaccggacgaccgtctgctgtgggacgtcggtcatcaggcctatccgcacaagatcctcaccggtcgccgcgagcgcatgggcaccctgcgccagaaggacggcatcgctgccttcccgcgtcgctccgagagcgagtacgacacttttggcgtcggccactccagcacctcgatcagcgcagcgctgggcatggccattgccgcccgcctgcaggacagtgatcgcaaggcgattgcggtgatcggcgacggtgcgttgaccgccggtatggccttcgaggcgctgaaccatgcgccggaagtgaacgccaacatgctggtgatcctcaacgacaacgacatgtcgatctcgcgcaatgtcggcggtctgtcgaattatctggcgaagatcctttccagccgcacttacgcgagcatgcgtgaaggcagcaagaaagtcctgtcgcgcctgcccggcgcctgggaaatcgcccgtcgtaccgaagaatacgccaaaggcatgctggttcccggcaccttgttcgaagagctgggctggaactacatcggcccgatcgacggccacgacctgccaacgctgatcgccacgctgcgcaacatgcgcgatctgaaaggcccgcagttcctgcacatcgtcaccaagaaaggcaaaggcttcgccccggcggaagtcgacccgatcggttaccacgccatcaccaaactcgaaccactggacgctccggccgccgcgccgaagcaggccagcgggcaaaagtattcagcagtgtttggcgagtggctgtgcgacatggccgccgccgatccacgtctggtcgggatcaccccggcgatgaaggaaggctcggatctggtggcgttcagcgaacgcttcccgctgcgctacttcgacgtggcaattgccgagcaacacgcggtgacattcgctgccggcatggcctgcgaaggcgcgaaaccggtggtggcgatctactcgacgttcctgcagcgtggttacgatcaactggtgcatgacgttgcggtgcaaaacctcgacgtgttgttcgccatcgaccgtgccggtctggtcggcgaagacggtccgacccacgctggcagtttcgatctgtcgtacctgcgttgcatcccgggcatggtcatcatgaccccgagcgatgaaaacgagctgcgcaagatgctcaccaccggccatctctacaacggcccggcggcagtgcgttatccacgcggcagcggcccgaatgccgccatcgagaaagatctcgagccgatcgaaatcggcaagggcatcgtccgccgtcatggcagcaaggtggctttgctggtgttcggtgtgcaactggccgaggcgctgaaagtcgccgagaagctggatgccacggtggtcgacatgcgtttcgtcaagccactggatgaagcgctggtacgcgagattgccggcagccacgagttgctggtgaccatcgaagagaacgcaatcatgggcggcgccggcggcgcggtcagcgagttcctggcacgggagaacatcctcaagtcgatgttgcatctgggcttgccggatgtttacgtcgagcacgcgaaaccggcgcagatgctggccgaatgcgggctggatgaggccgggatcgaagcgtcgattcgtgagcgtctgaccctgctcgacaagtaaacgcaatacccctgtgggagcgagcctgctcgcgaaggcggactgtcagtcaaatcattgctgactgatacaccgcattcgcgagcaggctcgctcccacatttgttttgtgtatatcaacaatgacaacggacgcccgatgaacctctcgcgcctcgccctgcccttctttctgctgccatcggccaacgccctcgccgacaccttcgagcgtgatcaggcactgaaactgccggacatgctgatctccgccaaccgtcaggtcgaagcccgcaacgacagcagcgccgccaacacggtattcactcgcgaagacatcgatcgtctgcaaccgagcgacgtgccggacttgctgcggcgcgtgccgggcgtgcaagtggcgcagaccggcgggcgcggcagtctgccggggatctacattcgcggcacgcaatcggcgcagagcctggtgctgatcgatggccagcgcatcggcaactccacctcgggcgacagcaatctgcagcacctgaacatcgcacagatcgagcgcgtggaagtgctgcgcggttcgcgttcggtgatctatggcagcgacgcgattggcggggtgattcagattttcacccgccgtggcagcgaacagggtttgcagccgcggatgcacgtcggttttggcagcaaccagacctgggaacgcagccttgggctgtccgggggcgacgataaaacccgcttcaatcttggtgcgagcctggatgaaaccgccgggatcgaccgtacccatgagtcgtacccaagcgacagcgatcacgatgcttaccgcaataagtccgtcagcctgagcctcagccatgcgctgaccgatgacatcgaaattggtgccaatctgctggataaccgaggcaagagcgagttcgacaaccccttcggccgcttcgacacgaccacgttcgattcggtgcagcagcagccatacagcgatttcaacgtcagcagcgtcagcagttacgtcgacgcgcgggtcaacgaaacctggaaaacccgcgtcgagttcggccacaccgaaaaccgcgagaagaccttcgacaaactcagcgacgagcgcacggtgttcaacacataccgcgactcggtgaactggcagaacgacctgactctggacgcgcgcaacagcctgatcctcggcggcgactggtacgaagatcgagtcaacagcagcaccgcattcgatgaggacagccgctggaaccgtgccgccttcatccagcatcgttatcaggctgacagcttttccaccgagctgggcctgcgccatgacgataaccagcagttcggtagccagaacacctggagtggcacgttcaccctgccactgaatccggacaacgatctgctgctcagctacagcgaaggcttccgcgcaccgactttcaacgacctgtactacccggatttcagcaaccctgatctgaagccggaaacctcgaaaagctacgagctgcaatggcgtagccagttgaccgacagcagccgtctcgaagcctcgatttaccgaacggatctggaagacgcaattatcttcggcagcaattcacgtccggaaaatgtcgcttcagcacgaatcaacggctttgaagcggcgctgaagcaggagctgttcgactggcagagcaatctgggcgtggcgatcatcgacccgcgcgaccgcgatagcggacacaccttggcccggcgtgcgcggcgcacgttgagttgggatctggatcgacagtttgaccaagtcagcctcggcgccagttggcaggcggtcagcagcagttatgacgacaaggacaatacgcaggcgctgggtggctatgcgctgttcggcttgcgcagcagttgggcgttgaatcgcgagatcaagctggatctgaaggtcgacaacctgttggacaagggttacagccgggcgaattacagctatgacggcagccagtacggttatcgcgaggaaggtcgagtgtggatgttcggggtgacctggactcccgaaatcaactgagccccctgtaggagctgccgaaggctgcgatcttttgatcttgatcttcggcgtttccgactcagtcaaacaacaaggtcaaaagatcgcagccttcggcagctcctacagaatcacctgttcggcgcgatcaactggcagagcttggcggtggcgtcgatcatctggccgctggggcgttcaaggcctttatcggtgaccaacagtaatttcccctgtttcaccgctgccacttgcggccaggccttccacgcattcaactgcgcctgatcccccgccagaatcacctccggatcacgctgcaacaccgcctcgatactcacctgtggcgccggcagactcagatcgccgaacacattgcgcgccccgcacacttccagcgcatcactgatgatctgcccgcccccgacggtgtacagcggcttgtcccagacttggtagaacacccgcaacggcacatcccggcgatagcgctggcgaagcgccgcgagttggtcgcgcaacgcagccgcacgtttcaccccacgctcgggacgccccaattgcgcggcaatggcttcgatctgcgcagcgagttgttcgagggaatgcggttcggcaacgaaggtcgggatgcccagacgcttgagctgatcacgctgcgccgggccgacgctgccgggccagagcaacagcaaatcaggctttaagctcagcaactgttccatgtcgagttgcccatagcgcccaaccgacggcacgctggcaatctcggtcggacgctcaccggcatccagcacaccgaccaacagatcagccgaatccagttcaacgacgatttcagaaagcgacggcgcgaggctgaccactcgcagttgcgctagcgcagggccactgacggccagcagcagaaccgccagccagagacagcgcatcagccgagttgacgcgggatacggtagagataaaacagcaccgccgtggacagtgccagcagcatcagtggcactgcttcgagaccgacgaacaccgccagtgcgccgatccacgccggcaaggctgccgcgagaaaagccgcacgacgacgggctgcgagggcaatccacgctgcaggttcatccggggtatcgagggctttctgcgtggcgatcagcgcatgtttgtaacggccgaaaaacttcaggctgacaaacatcgatgccacaccggcgataaaaaacggcatcgccagtactggcagaattcctttgccctgaccaaacagtgcgttgagcacgaacagcggcaccagcgccagcgccaggtatttccaccaatcgaccgacaatcggcgccgcacctgaccacgggtcacgcgcgatcaacctcaccctggtgctcgttgcccatcatgtggtcgagcttgctggccttggtcgccaggtacagtttgttgtgcgggttgtggccagtgtgcaacggcacgcgctccgccacggtgatgcccatgtcggtcaaggctttgaccttgcgcgggttgttggtcatcaggcgcagggatttcacgcccagatgctcaagcatcggcaggcacatggcgtagtcgcgctggtcggcggcaaagcccagacgctcgttggcttcaacggtgtcggcgccgccgtcctgcaattcataagcgcgaatcttgttcagcagaccgatgccacgaccttcctggcgcaggtacagcaacacgcctcggccttcgcgggcgatggctttcagcgcgccttccagttgcgaaccgcagtcgcagcgctggctgaacaaggcatcgcccgtcaggcattcggagtgcaaccggccgagtaccggggcaccgtcggcaatttcacccaggctcagcacgacgtgctcgcggccggtggcttcatcgagaaaaccgtgcatggtgaattgcgcaaaaggtgttggcagcttggaagcggcgacaaagacgacaggcaccggtgtgctcctgatctaaagagtctgaaaattcgcaggcgggcattgtaacagcaggttcctgcagacgcttaggctgaattatcggggataacgatcaaaaagtttgataactaccccacagacgctgcggcccccttgtaggagtgagcctgctcgcgatggcggtgtgtcagccacatcaatgtttggataagaccactatcgcgagcaggctcactcctacaggggatttgtgcaggccttcagtccgatccgaacggatacggctgctgccacttctcgaaaatcggtttcaactcgccgctcttcaccaactgctccatacgctggtcatacagagccatcagcgctcgcgcctgcggagtgtcggcaaagccgagaaacagcggcagctcggccaggtgtgaatagcgatactgcgctggatcggctgcggttttcaccacggcttcaatctcggtcaacgcatcaatgtagtaatccgcccgcccctgcttgagcatcgacagaatgccggtacgacgctcgatctggttgtaacgcttgatgttcggcaggtagttttcgtaacgatagccacgcacccaggccaggcgatacttgcccagcgtcgcctgagtcggcgatgggttgctcgccagacccagtgcgtaaatgtggtcggaatcaaaattccagtgcggatacaggacttgctcggcttcgtcgcgataggagccgaccagcgcgtcgacttccttcaactgcaccagaccgatcgaacgggtgtacggcaccgtgcgaatgtccagcttcacgccggccggttcgaacaccttgcgcaacacgtcccaaccgaggccatggccgtcggcggcggtgtagtcttcccagtcttcgctggccagatggatgaccgcaggcgtcggcacagcttcctgcgcactggccaccgtgcccagcaaagcaaaaaacatcaccgccaaccagcgtcgagccatccctagtctcctcacttacccctgacatcccttggaatcaggcgaaaacccacaccagcccctgcatcgccagccaggcaaatacgccggccagcacgtcgtcgagcatgatgccgacgccgccatgcacatgccggtcgatccagcgaattggccatggtttgagaatgtcgaagaaccggaacaccagaaaacccgcgagcaaccagtaccagccttccggcaccagccagagggtgatccacatcccgaccatttcgtcccagacgatgccttcgtggtcgtgtacccgcagatcgtcggcgaccttgccgcacagccagaagccgaacagcatggtgatcccgagcatcaaccagtaaccccaatcgggcaacatctgccacaacggaataaagggtagcgcaactaacgagccccacgtgcccggcgctttcggcaaggtgccggagccaaagccgaacgcgaggaaatgccagggattgcgccagaccgacggcggaacgaattcggccggaacctgtttcgggtgatctgtcacggtgtctcctgaaaatgttgatagccccggatttgcggggtgatgtcgtgcccttcgcgatccagcagaatcacgccctgaccttctgacacacgaccgatcacatggatcggccagccattggccaacaacgccggcaactcgacggacggcagggtgaaggccagcacgtaatcatcgccgccgctcagcgcggcacgctcggcgccgcgctgaccgagaaacgccactaatgcatccgacagcggtacgcgctcgcgttcaatctcaagccgcacctgtgatgccagcgcgatatggccgcaatcggcgagcaggccatcggagatatccagcgccgacgtggctttgccgcgcagggcctgaccgagggcgagttgcggctgcggcgaccagtaatgatcgagcagcggttgggcgataggcgcttcggcgtcacgctgccccagcaccagcggcagtgcgccagcggcattgcccagctcaccgccgacacatagcaagtcacccggctgcgcaccgctacgggtcaacgccaggcccgcaggcacgcgaccaaacacggtcaccgtcaggctcaacggcccgcgcgtggtatcgccgcccaccaacgcaacgccgcagttctgcgccatgcggttcaaaccgtgggcataggcttgcaaccaatcggcagtcaccgtcggcacagtcagggcaagggtaaaggcaacgggcgtggcgcccatggcggccagatcgctgaccgcgacggccagcgagcgctgaccgagcagaaacggatcgcaggggtcggcgaaatgcacaccggccaccagcgtatcggtggaaatcgccaactgttccccggggggaacagcgagcaaggcgcagtcatcgccgatccccagagcaacgccttcgccgccctgcgcacaaggcgcggcggcgaagaaattgcggatcagctcgaattcgcccattgaggtttcaagcgcgtttcagcgcttgaacgccttcacttcagcttcacgcaggcgcggcgccagcttgtcgagcacgccgttgacgaacttgtgaccgtcggtcgaaccgtagactttcgccagctcgataccttcgttgatcacaacgcggtacggcacgtcaacgcgcttgagcagttcccaggtcgacaggcgcagtacgcacagttcaaccgggtcgagctcttcgatggtcaggtccaggcacggcgccagcgcagtgtcgatctcggtcagactggccggaacaccgtgcaggatgtcgtggaagtagctggcatcggcgaaggtgaaatcgttatcgacgcggaactgcgcttcgatttcgttcagcgaagtactggccatgtggcgctggtacaacgcttgagtcgccaactgacgggcagcgcggcgcttttcacttttcgaaggcttgccggcgtcggttggacgcggctcgcgcgggttgaaacgatcgctttcgtcgctaatcacttggcctccaactgcgccagcaggctgaccatttccagagcggacagggcagcttcggcacctttgttaccggccttggtgccggaacgttcgatggcttgctcgatggaatcaacggtcaggacgccgaaagcgaccggcacgccgaactccatggacacctgggccagacccttggtgcactcgcctgccacgtattcgaagtgcggagtaccgccacgaatgaccgcgccaagggcgatgatggctgcgaattcacctttctgggcgactttctgcgctaccagcgggatttcgaaggcgccaggtgcgcggatgatggtgatgtcgctttcgctcacgccgtggcgaaccagggcatcaactgcaccgctgaccaggctttcaaccacgaagctgttgaaacggcccactaccaaagcgtagcggcctttaggggcgatgaaggtaccttcgatggtcttcagggtcattcgtcagttctcttaaagagccgggacgcgtctgctacgcgtccctcagtgatttatttgccgcgaatcggagtccggaaacaaccggtcattattcggagggcacgtattctacaacttccagatcgaaaccggatatcgcattaaatttcattggcgcagacatcaagcgcattttgcgtacaccaaggtcacgcaggatctgcgaaccggcaccgacgatgctgtaggtggtcggttttttcggcgccggctgatcaccggtttcgcggatgtgcgccagcagcacgtcgccatcgagcgggtgaccgagcaacagcaccacaccgctaccggcctcggcaaccgccgccatggcggcgcgcaggctccagcggccgggttgcttgaccatcagcaagtcacgcagcggatccatattgtgcacgcgaaccagcgttggctcttcggcgcaaacagtgcccagggtcagcgccatgtgcacgtcgccttccacggaatcacgataggtcaccaggttgaattggcccagttcgctgtccagcggctgctcggcaatccgctgaacggtacgttcgtggatcatccggtagtgaatcaggtcggcaatggtgccgatcttgatgttgtgctcagccgcgaaagcttccagttcggcgcgacgggacatggtgccgtcgtcgttcatcacttcgcagatcactccgctcggctcgaaaccggccatgcgtgcgaggtcgcaagcggcttcggtgtggcccgcgcgcgcgagggtgccgccggcctgcgccatcagcgggaagatgtggcccgggctgacgatgtcttcagccttggcatccttggcagcagccgcttgcacggtgcgcgcacggtcagcggcggagatgccggtggtcacgccttcggccgcttcgatcgaaacggtgaacttggtgccgaaaccggaaccgttgcgcggcgccatcagcggcagcttcaacagttcgcagcgctcgcggctcatcggcatgcagatcaggccacgggcgtgcttggccatgaagttgatgtgttcggcctggcagcactcggcggccatgatcaggtcgccttcgttctcgcggtcttcgtcatccatgaggatgaccatcttgccttggcggatgtcttcaaccagttcttcgatgctattgagcgccacaaggcaccccccttctttcgaatttagagcttcaggatttgaggtagccgttttgggccagaaagctttcagtgatcgtgccgccggatgtcgactctgcggccttgtcgcccaaaagcagacgctccagataacgtgccagcaaatcgacttccaggttcacccggcgacccggcgtgtacgacgccatgatggtttcgctcagggtgtgcggaatgatcgtcagcatgaactcggcgccatcgacggcgttcacggtcaggctggtgccgtcgacggtgatcgagcctttatgggcgatgtacttggccaggtctttcggcgcgcggatgcgaaattccacggcgcgggcattgtcgctgcgcgcgacgatttcgccgacgccgtcgacgtgaccgctgaccaggtgcccgccgagacgggtggtcggggtcagggctttttccagattgaccgggctgccgcttttcaggtcattcatggcggtgcagtcgagggtttcacggctgacgtcggcggcaaagccgtcgcctggcagttcaacggcagtcaggcagacgccgttgaccgcgatgctgtcgccgagtttgacgtcgctcaggtcgagcttgccggtggcgacgtggacccgcacatcaccgccctttggggtcaatgcgcggatactgccgatggattcgatgatgccggtaaacatggggttctccttgagaactgagccagcgctaacgcgatggccgggaattatacgctcgccgaaaggacagggttggcagtgactcgccagtcatcgcccaccgcgcgaatttcagtgattttcagctccggcgcatccttcatatgggccagcggccagtccagcaatggacgcgccgtggaaccgagaaacttgccggcgatgaagatcacgaactcatcgaccagacccagctgagcaaaggcgccggccagacgtgggcccgcctcgaccagcacttcgttgacgccgcgaccggccagttcgatcagcaattgatgcagatcgacctgcccgtcctcacccggcacgatcaggcactcgggaccgtgagcgtattgctcttcgatcgcgacacaggtggcgaccaacgccgggccggccttgaagaacggcgcatccagcggcacccgtaggcggccgtcgatcaatacgcgtagcggcggacggctcatgaccaatgcggtttgttcggtatccagacccaattcatcggcccgcacagtcaaacgcgcgccatcggccagtaccgtgtcggcaccggtcagcaccacggcggcctcagcgcgcagacgctgtacggctgaacgtgcggccgggccggtgatccattggctctcgccgttttccatcgctgtacgaccgtcgaggctcatggccaacttgacccgcacgaacggcaagccgtgttccatgcgtttcagaaaaccttgattgagcttgcgcgcttcagcttccagtacaccgctttcagtggcgatgccggcatcggccaggcgctgcaatccacgtccggcaacctgcggattagggtcacgcatcgctgcgaccacgcggcctacgccagcattcaccagcgcatcggcgcacggcggcgtgcggccatggtggctgcacggctcgagggtcacataagcggtcgcgcctcgggctagctcaccggcggcgcgcaacgcatggacttcagcgtgcggttcgccggcacgttgatgccagccttcgccgacaatctgcccgtcgcgcaccaccacacaacccacccgaggattgggatgggtggtgtagtgacctttgcgcgccagttccagcgcacgcgccatgaagtgggcgtcgaggatggcctgctcggcgacggtggtcattctttcaccggttcgcgggcgaggcggtcgatttcttcgcggaattcgttgaggtcctggaagcgcttgtacaccgaagcgaaacggatgtaggcgacttcatcaagcttttgcagctcggccatgaccagttcgccgaccacgagggatttgacctcgcgctcgccggtggcgcgcagcttgtgcttgatgtgaaccagagaggattcgaggcgctcgacgctcaccggacgtttctccagggcgcgttgcatgccggcacggagtttttcttcgtcgaacggttggcggctgccgtcggttttgatcaggcgcggcaacaccagttcggccgtctcgaacgtcgtgaaacgttcgccgcaggccaggcattcacgccggcggcgcacctgttcgccctcggcgaccagacgcgagtcgatgaccttggtgtcgttggcaccgcagaagggacagtgcatggtggctggcaacaaaaaaagggagggccatggtagcgcatcccggtggcaagacaagccataggctttgcggtatacagaacggcatgatcgtttgatccatggatttcattttgccggagcatccaatgccgttacgtccgctcgttttgctcagtcttttcagcctgctggtggcctgtggcagcgatgcacccaagcctcagccgccgacgccaggccccgcgccgcaacaggcgcagaaaaaagccaaagaggccgccgagcttggcccgctgcccgcctatcaacgcgaattgagtggcacccttcagggcgtgccggccggtgccgaagtcgagctggcgttgctggtgatcgatgcaaaggatcgcccgcaacaattgctcgccagttccagcctgatcggcaacaaccaggttctaccgttccgcctgcgtttcaacccggacgccttcccgaccggtgcgcgggttgagttgcgcggtcgcgccagccagtccggccagttgatcctgcatctgccatcgcaaaccatcacccagccgaccactcaggcgctgggccaactgcaatttgtcaaagcaccatgacggcaccgctcgacctgcaacaggcgttaggtgaactgctcggcgacgccagactcaaggtctgtgcgttgccggacaccgaattgcagctgtggctgatcgatggcgacaacatggatcgccaattcagtcaggacgaaatccagcgaattctgcacgagccaccctattggggtttctgctgggccagcggtctggcggtggcgcgctatctggacgagttcccggagtgggtgcgcggcaagcgtgtgctggatttcggcgcgggttccgggattgccgggatcgcggcggttaaggccggggcgctggaggtggtagcctgcgatctcgatccgctggctatttccgcgtgccgggcgaatgccgcgctgaataatgtcgagatgagttattcgacggatttctttgccgaggccgaccggttcgatctgattctggtggctgacgtgttgtacgaccgggcgaatctgccgttactcgatgcgtttttaagccgtgggcgagaggcgttggtggcggattctcgggttcgggattttcggcatccgttgtatgagcgcattgaaatgcttgaggcgatgacgttgccggatctggcggagcctgaggaatttcggcatgtcagcctgtaccacgcgcggcgtgattgaaatcgttaaaagatcgcagccttcggcagctcctacagtgatcggttttgtcgtccatattgcgggcggacactgaacctgtaggagctgccgaaggctgcgatcttttgcgccaccgcttatagtgcgttcattaacgctttgacgagatcccccatgagtgagcaaacgccgtacatcttcgacgccacgacggccgatttcgaccagtcggtgatcgaggcttctttcaacaaaccggtgctggtggatttctgggccgagtggtgtgcgccgtgcaaggcgttgatgccgatgttgcagggcatcgccgagagctatcagggcgagttgctgctggccaaggtcaactgcgacatcgagcaggacatcgtcgcccgtttcggcattcgcagcctgccgaccgtggtgctgttcaaggacggtcaaccggtcgacggttttgccggtgcacaaccggaatccgccgtgcgcgccctgcttgagccacatgtgcagatgccaccaccggccgcagccgatccgttcgagcaggctcaggcgttgttcgatgacggtcgttacgccgatgccgaagcggcgctggtggtgatgctcaatgaagacaacaccaatgccaaggcgctgattctctatgcccgttgcctgactgaacgcggcgaactgggcgaagcgcaaaccgtgctggatgcggtcaagagtgatgagcacaaagccgcactggccggcgccaaggcgcagatcaaattccttggcctggcgcgtgatctgccggatgctgccgacctgaaaagccgtctggcgcagaatccgcaggacgatgaagcggtgtatcaactggcgattcagcaactggcgcgccagcagtatgaagcggcgctggatgcactactgaagttgtttatccgcaaccgcagctacagcgaaggcctgccgcacaaaaccttgctgcaggtgttcgagttgctgggcaatgatcatccgctggtgacggtgtaccgccgcaagatgtttgctgcgctttattaagatcaaaagatcgcagcctgcggcagctcctacattgggatcgtgtacacccttgtaggagctgccgcaggctgcgatcttttgcggttcactcgatccagctgtagagcggcgtatccccgccgctcaccactttcacgtccgaactgtggcgcaggcgtaccagcaagcgcttgcccgccgccgcgctgcccgtcagtccttcaagctgatcaagcagatccggcccgctgagttgcccggccttgcgcaacagatccttggccacctgccacaacgcgtcgtcctgattcagcggtttcgccgctggcgccgacgcggcgacctcaggttgggtgatcggtgcctgcgcattcagcgccgaaccgagcttggcccagtcgttgtcatccagttccaccatcaagtccaccggcacgtcgccgacggttccgcgtatccgcaacattgagttcgctcccgcacatttatgacctgcatgctcccacgggacttgtgcaacgccaagcgcacgggcaaactctgcggactttcgttataagattacataacaaactcttcactttacttcccggagaccatcatgcgtcgtctgctgctcgctttgccgtttgccctgttgccgctggccatcgcccacgcggctgatgagcatgaccacgatcacgatcatgaacacggcagccttggcgcgcatgaacatggtgttggtcgactgaacgccgcgctcgatgggcagaccctggagcttgagctggaaagcccggcaatgaacctagtcggtttcgaacacgccgccaccacggatgccgacaaggccaaagtcgctgcagcccgtgcgcaactggaaaagccgctggccctgttcagcctgccgtctgctgccggctgcacagtgatcagccaggaactggagagcccgctgttcggtgacaagccggatgccgacgaccatgacgacgatgaagcggacaaggacggccacgagcatcaccacgaccacagcgaaatccatgcgcattaccaattcagctgtaccacaccaggtgcgttgaagaccctggatctggcgaacgtcttcaagaccttcccggccacgcagaaaattcaggtacaactgatcagcacgaacggccagcaaggtaccgaagtgacggccaaggctgccgcgctgaagttctgatcactccgtaaatcccctgtaggagctgtcgagtgaaacgaggctgcgatcttttgattgtaaaagccaagatcaaaagatcgcagccttcggcagctcctacaggggttctgtctacaactttgaaactggtgccatgacccaagcactcatcgaactgtccgacctgggcttcaactggcccggccacccgccgttgctggacatcccggcgtttcgtctggaagccggcgaaaccctgttcctcaaaggccccagcggcagcggcaagaccaccctgctcggcctgctcggcggcgtgcagaagcccggtcgcggcagcattcgcctgctcggccaggaactcaccgaactctccgccggcgcccgcgacaccttccgcgtcgatcacaccggctacatcttccagcagttcaacctactgccgtttctctcggtacgcgagaatgtcgagttgccgtgtcacttctcgaaactgcgcgcgcaacgggcgaaacagcgccacggcagcgtcgaccaagccgctgccaccctcctcgcccacttgggcctgaaggatgaaagcctactcagccgtcgcgctgattcgctgtccatcggccaacaacaacgcgtcgccgctgcccgcgccttgatcggtcagcctgagctggtgatcgccgacgaaccgacctcggcccttgactacgacgcccgggaaaacttcattcgcctattgttcgccgaatgccgcgaagccggttccagcctgttgttcgtcagccacgaccagagcctggcgccgctgttcgaccgtcatctgtccctggccgaactcaatcgcgccgccacgtctgccgaggtctgagatgtatctgtttcgtctggccatggccagcctggccaaccgccgctttaccgccctgctcactgccttcgccattgccctgtcggtgtgcctgctgctcgccgtagaacgggtgcgcaccgaggccaaagccagtttcgccagcaccatcagcggcaccgacctgatcgtcggcgctcgctccggttcggtaaacctgttgctgtactcggtgttccgcatcggcaacgccaccaacaacatccgctgggacagcttcgaacactttgccaacaacccgaaagtgaagtgggcgatcccgatgtccctcggcgattcccatcgcggctaccgggtgatgggcaccaccgaagcctatttcgagcattaccagtacggtcgccagcaacatctggcactcgccgacggtcgcgcgtttgccaccgatccgtttgaagtggtgctcggcgcggaagtagccgatgcgctgcattacaaactcggcgacaaactggtgctggcccacggtgtagcggcgatcagtctggtcaaacacgacgacaaaccgttcaccgtggttggcatcctcaagcgcaccggcaccccggtcgaccgcacactgcacatcagtctcggtggcatggaggcgattcacatcgactggcacaacggcgtgccggcccgaggcaacgggcggatcagcgcagatcaggcgcgcaacatggacctgacgccgcaagcgatcaccgcgttcatgctcggcctcaacagcaagatttccacctttgcactgcaacgcgagatcaatgaattccgtggcgaaccgatgctggcgatcctgccgggggtggcgttgcaggagttgtggagcctgatgagcaccgctgaaaaagcgttgttcgtggtgtcgttattcgtcgtgctgaccggattgatcggcatgctcacggcgattctcaccagcctcaacgagcgtcgccgcgagatggcgattctgcgctcggtcggggcgcggccgtggcacatcgcgagcctgctggtgctggaggccttcgcgctggcactgaccggcgtcatcgcaggtctggcgttgctgtacatcggcatcgccgccgcgcagggttacgtgcaggccaattacggtttgtatctgccgctggcgtggccgagcgagtatgaatggacgctgctcggtggcattctggcggccgcgctgctgatgggcagcgtgccggcctggcgcgcttatcgccaatccttggccgatggcctgtcgatccgtttatgaggatgttcaccatgccccgcgctgcacttgcgctgctgttgctggtcgccctgcccgtgtgggcagcggcgccgaaagacctgacgtggtcggaaatgattccgccggacgccgcgccggaagtaccgaacatgacgccgctgcacgacctgtcgaagatgggcgatgcgttgtctgccgagtccgcgccagcggcgaagcaggatctgccgaatgcgccggtggtgcagtcactcgacgggcagaccattcgtttgccgggctacatcgtgccgctggaagtcaacgaagaaggacgcaccacggactttttgctggtgccgtatttcggcgcctgcatccacgtgccgccaccaccgtcgaaccagatcgtgcatgtcaaaagcgagttgggcgtgaagcttgatgagctgtatcagccgtactgggtcgaagggccgttgcaggtcaaggcgtcgagcagcgaactggcggatgccgggtatcagatggatgcggacaagatttatgtgtatgagctgccggagtaaatcccggtagttttgtgccgtctgtaagggcctcatcgctggcaagccagctcccacagtgattgagtcgttcacaaattttgtgatcatcaacaaaacctgtgggagctggcttgccagcgatgaggcccgcaaaggttccgcaaaagtctgccccttcactgtttcattgagctgcgtcaaaagaccgtatcagttggcttcgtaccataggacatcagaaatttttaacgtcctttggagcccccatgaacaagtccttgctcagtgcttcgctgtttgccctcgcgctcgcagccccgctcgcccacgcccacgaggccggtgacatcctcatccgcgccggtgcaatcaccgtcaacccgaaggctgacagctccagcgtcaaggtcgatcaggggccgttgagtggcaccaatctcggcggcaaggcgaccatgagcagcgatacccaactgggtctgaacttcgcctacatgctcaccaatcacgtcggcatcgaactgcttgcggccacgccgttcgagcatgacgtcaagctcaagggcactgccctcccagccgcgaacggcaagctcggcacactgaagcacttgccgccgaccctcagcgtcgtctactacccgctggattcgaagtcggccttccagccttacgttggcggcggtatcaactacacctggatctatgacgagcacgtcggcagcgaagcgcagactgcaggcttcagcaacttcaaggcgaaaaactcctggggtctggcctggcaggtcggtgcggattacatgctgaccgacaacatcatgctcaacgcccaagtgcgctacatcgacatcgatacccgcgccactgtggaaaacaacgccgtcgctccgggcacccgcgcaagggtgaacgtcgatgtcgatccgttcatctacatggtcggtctgggctataagttctaagctgatttttaccgaacgttcacgtggtggtgaatgaggcttggtggtgagcaggcttagaactgacggcgaccgtacgcagttgatcgggggataacatcccctcgccacaggaatggcgacaaattccggccgtgaaaaaggcgcctgtcaaagggcgcctttttcatgtctgctggaaacctgtggcgtgagttggatctccccctcatcccagccctctccctcagggagagggggaaagggagccgatttgtgtgcttttcaaatccgagttcgactcgatacctcagttcggtgtatctcatccgaacgcctcggtgagcaccctctccctatgacagagggaaaagggagccgatttgcggtgtcttcaaaacctgagttcgactcggtatttcacgtcggcgtaactcgaaagtacacctcgatcagtcccctctccctcagggagagggttggggtgagggggcttttcagtagcgaccgagcaaccgcgccaaacccacactcatcggcgtctgctctggcagcttgaagcgctccagcaagcgagcgttgtccgcccgcgagtgacggatatcgccggaacgcgccggcccataactgatgggcggcaattcaccgaccaccgcttgcagggcttcgagcatctgcttgaggctcatcgactgattccagccgacgttcaccgcaccgacgtccacttcagacttttcaatcgcctgtaccagcacatcgaccagatcctcgacgtagaggaaatcccgcgtctgctcgccgtcaccaaacacggtgatcggcaggcctttttgtgcgcgctcgctgaaaatactgatcaccccggagtacggcgaggacggatcctgacgtgggccgaagatgttgaagaaacggaagatcgccggttccagaccatgctggcgacgatagaaatcgaagtagtgctcaccggccagtttgtccgaggcatacggcgtcagcggcgctttcggcgtgtcttcgtcgatcgactggccttcaccgttgttgccatacaccgccgcgctggaggcgtacagcacgcgtttgaccccggtctggcgcatcgcttcgcagacattcagcgtgccgatgaaattgctctggtgggtttttaccggatcatccaccgaggcctgtaccgaggccacggcggccaagtgcgccacagcgctgcaaccctgcatcgcttgcgcgaccagtgcggcgtcggcgacatcgccaacaatcagctcgaccttgggattgtccagcggcaggttggcgcgtttgccagtcgacaggtcatcgagaatgcgcaccgaatggcccttggcaagcaaggcgtcggtcaggtgcgagccgatgaaaccggcgccgccggtgattaaaactgggccttcagccatggcgataaaacctatccagtaaagccgggagcgcagcacgccaggcgcgcggcttgatcccgaaagtgtgcagaattttcttgcaggccagcactgcgtgttgcggctcttcggctgcgtccgggcgcgcggcgtgagcctgtgcggtcggcgcttcgatggccagggcgtgcaggctgcgcgcttcggtcagaatcgcctggcccagcgccagcggggtggtcgcttcgtggccggcgtagtgataagtgccccacagcggcgcggcgcaatcgagttgcttgagcaccgaaatgattacccgcgcagcgtcgtcgaccggggtcggattaccgcggcggtcatcggccaggagcaattcttccggatgctcggcgcgggcgaggaaacgcccgagggtgccgtcggcgctgtcatcgagcagccagccgaaacgcagcaacacgtgctgcgggcacgtcgcgcgaacgctctgttcgatacgccacaaggcctgaccgcgcagaccgagcggcaccggttcgtctttttcgctgtaagcagtcgcacgcgagccgtcgaacacccgatagctggagggctgcacgaggacaatgttgtggtgctggcacagttcggccagacgttcgattgcacgttcctgtccggccatacggctttcgctgacggtttccgcctggaaccagtcgaaatagtaggcgaggttgatcaacgcatcgggacgggtgtcgtcgagcaattgggtcaggctcgcggcatcccagccgttttcgggcgggcggggggcgaggaaaccgatgtcttcctctgcaccgaggcgaatcagcgcctgcccaagggcatttccgccgcccagtaacataaggcgcattcgcatagagtcagcaggcccagtctggttggaacgatggctttagcgacagatcttgtggaaccgtcgccgataattgccggaatcgttgcattttgcgggtttagtgcgcaaccgtcatccgtaaagtgtacatcccggatatttgtagcgcttcgactggcgccatcgcgagcaggctcactcctacaattgaaatgcattcccctgcaggagtgagcctgctcgcgatgaggcccgaacggtacttgcatcttcccccctgcgcccgcataacttagccatgaatctgcccatccccacggacgcggccctggcaggctttcaccccgccgtcagcgcctggttccgcaagaccttcccgacggtcaccgccgcccaggcccgcgcatggccgttgatccgccagcgccgctcgacactgatcgccgcacccaccggctcgggaaaaactctgaccgcgttcctcgccgtgctcgacgacctcgtccaccgaggccttgcaaaccccgatagcctgcccgatgaaacgctcgtcgtttatgtctcgccgctgaaagcgctgtccaacgacatccgcatcaacctgcaaaacccgctggccgggatcaccgaacagttgcggcagatgaacctgccgcaagtacacatcaccaccgccgtgcgcaccggtgacaccccgcaaaaagaacgcgcggccatgcgcaaaaacgcgccgcacattttggtgaccaccccggaatcgctgtacgtgctgctcggttccgactccgggcgaaaaatgctcggcaccacgcgcacagttatcatcgacgaaatccacgcgatggccgccggcaaacgcggcagtcacttggccctgagccttgaacgcctgcaggccttgtgcgccgaaccgctgacccgcatcggcctgtctgccacgcaaaaaccggttgaagccgtggcgcaatttctggtcggtcatggtcgcccctgcgaaatcatcgacattggtcacgcccgcccccgggatcttggcatcgaagtcccgcccgtgccgttgtcggcagtcatggccaacgacgtttgggagctggtctacgaccgcctcgccgaactggcccgcgagcatcgcaccacgctgattttcgtcaacacccggcgcctggccgaacgcctgagccgacacctcagcgaacgcctcggcaagcatgcggtagccgcgcaccacggcagtctggccaaggagtttcgcctcgacgccgagcaacgcctcaagcgtggcgagttgcaggtgttgatcgccaccgcctcgctggaactgggtatcgatatcggtgaagtcgatctggtctgtcagatcgcttcgccgcgctccatcgccgggtttctgcaacgcgtcggccgttccggtcaccaggtgggtggcacgcccaaaggtcggctgttcgccaccacccgcgacgacctgatcgaatgtgccgccctgctcgactgcgtgcgccgtggcgaactcgataccctgcacattcctgtcgcgccgctggatgtgctcgcgcagcagatcatcgccgaagtcagctgtcaggaatggtcagaagacgccttgctggcgatgttccgccaggcctcgccctatcgcgatctcgatgcaaaacattatcaagcgctgctgagcatgctcgccgaaggctacaacggtcgtcagggcatccgcagcgcttatctgcatcgcgacgccgtcagccgcaccttgcgtggccgccgtggcgcgaaactcgctgccgtgaccagcggcggcaccatccccgataacgccgattacagcgtgatgcttgagccgcaaggcctgaacatcggcagcgtcaacgaagacttcgccgtggaaagcattgccggcgatgtgttccagctcggcaatacctcctaccgcatcctccgtgtggaaaccggcaaggttcgagtcgaggatgctcacggccagccgccgaccattcccttctggctcggcgaagcgccggggcgcagcgatgaactgtcgttcgccgtggcacgcctgcaagcgcaactcgacgaactgcttggcgccagccccggagacttgcaaccagcgctcgactggctgacacagcccctcggtctcaaccgcgccagcgccgagcaactggtcgaatacctcgcccgcgccaggcagaccctcggcgccctgccctcgcaagatactttgctgatggaacggtttttcgacgagtccggcggcacgcaactgatcattcattcgccgttcggcagtcgcgtcaaccgtgcttggggtttggccctgcgcaagcgcttctgccgcaccttcaacttcgaattgcaggccgctgccagcgaagacgcgatcgtcctgtcgctgtccaccagccacagctttgaactcgatgagatctggcgctacctgcacagcaacagcgccgagcagatcctcattcaagcggtgctcgatgcgccgctgttcggcgtgcgttggcgctggaacgccggtgtggcgctggcattgccgcgttttaccggcgggcgcaaagtcgcgccgcagttgcagcggatgaaaagcgaagacctgattgccagcgtgtttcccgatcagatcgcctgcctggaaaacctcgccggcgaacgcgaaatccccgagcatccattgatcgagcaaaccctcgacgactgcctgcacgaggcgatggacagcgaaggctggctcaatctgctgcggcgcatggagcgtggcgaggtgcgtttgatcagccgcgatctgccagcgccctcaccgctcgcggcggaaattctcagtgctcggccgtacgcttttctcgacgatgcaccgctggaagaacgtcgcactcaagcggtgatcaaccgccgctggagcgatccgcaatcgactgatgatctcggtgcgctggatgcagacgcgataaacgccgtgcgcgaagaagcctggccgacgccgaacgctgtggatgaaatgcatgaggcgctgatgagtctggcgtgcatcagcgaggatgaggtgcaagcgaacgaaggctggcgcaaatggctggaaaccttggccagcagcggccgcgcctgccgtttgcaaatcgattccgagcattgtttatggctggcccgcgagcgcctgacctgcctgcaagcactttatccacaggctaaattgcaacccgggctggaggccttgccgggattcgatgaaacctggacgtacgatgaggcattggtcgaagtgatccgcgcacggctcggtgctttcggcccgttgccgttaaccgctatcgccgaaccgctggggctgccaaccactcaagtcaaccaagcgctcgcccaactcgagcgcgaaggctatgtcctgcgcggtcaattcacgccgaaactgaacatcgaagaatggtgcgaacgtcacctgctcgcgcgtattcatcgctacacggtcaagcgtctgcgccgggaaatcgaaccggtggctttgcaggatttcatgcgatttctgttcgactggcagcatctctcgccttcgacgcggggccagggcggcgcggtgttgccggcgattgtcagccagttcgaaggctacgcagcggcagcttcggcgtgggacagcgacattctgccggcgcggctcaaggactattcgccgagctggctggatgagctgtgccgcaacggcaaactggtgtggacgcgcctcagtgcccggaaaaaaatcagcggaacggcgttgcgcagtacgcccatcgtgttgctgccgcgcagtcaggttggcttgtggagtgcgctggccgaacagacgcccgtaagcgaactgtcgccgaaaacccagaaggtctttgaagcgttgagtcagcacggcgcgctgtttttcgatgagttgattcatgaggcgcatctgctgcgcaccgagctggaaatcgctctgcaggaactggtcggtgccgggatggtgaatgccgacagcttcgctggcctgcgtgcgctgatcaccccggcgagcaaacgccagcagcgcagcagtcgtcgcgggcgcggcgcgtttgttggcggcatggatgatgccgggcgctgggccttgctgcggcgcggggcagctgtggataacagcgaaaccctggaacatgtcgccatgaccttgctgcgccgctatggcgtggtgttctggcgcttgctggagcgtgaggcggattggttgccgagttggcgggaattgctgcgcacgtttcatcgactggaagcgcgcggcgagattcgtggtggacggtttgtcagtggcttggcgggggaacagtttgccttgccggaggcgattccacttttacgcgaagtacgtcggcggccacaggacggcagtctggttgcggtgtgcggggctgatccgttgaacctcgccgggacgttgttgccgggggtgaaagtgccggcgctggtgagtaatcggttggtgtatcgggatggtttgccggtggccgcggagattgccggcaagcagcagttctggctggagctggatcagatcggcatggagcaggtgcgcggcaaattgatccggcattgatgtcggctgttctggcgctatcgcgagcaggctcactcctacaggggaacgctttccaaaggtaggagtgagcctgctcgcgatgacgccagtattaccaacacaaaacccgatattaagtcctcgattcatgtggcacctcgctcaccaccacctcactcccctgcgaacgcttcggcaacaaaacctgctgtggataagtctgcgcgaaatgcaccgtctcggtgttatccacaagcttcttcaaacgctgattgaacgcccggctcaccgcatactgcccacccgacacggtgcggaattgcgccgtgagcaccacgccgttcaaatccatcctgtccacgccaaatacatccagcggcccttgcaggttgtacttgaggaacgggtcttcgcggatcgaatcgccggtctcacgaatcagctcgatggccttgtccacatccgtgtcgtaagtgaactgcacagagaaaaacgcaaaggcaaactgccgcgattggttggtcacagccttgatctggccgaacggtaccgagtgcacaaaacctttaccgtcacgcagacgcagggtacgaatggtcagcccttcgaccgtgccggcatggcccgaatcgagcaccacccaatcgccaatcgacaaggtgtcttcgatgatgatgaacaacccggtgatcacgtcctgcaccagttgctgcgaaccgaaaccgatggccagaccgaccaccccggccccggccagcagtggcgcaacgttgatccccagattggccatggtggtgatcgcacagatcaccacgaggatgattttgatcgcgttgcgcagcagcggcaggatggttttcacccgcgtacttggctggcgagcgccgcgcttgctgactggtggcttcagtgcttcctgaatcgccgtgtcgagcaccacccacaacagccaggtcaccaggaagatcagaccaatgctactcagcgcattactgatcgctcgcccgaccgtgctgctctgggcgaaatcaagcagcgacacgccccagatccgtccgagaatatcgatgaaggcaatcgcgatgacgatccgcagcaaggcatgcaacaggctcaggaagcgttccttataggcgctgctgcgctggatcgcctcggcttttcgtgacttgaacaagtgctgcagaatcgtgctgagaaacaccgtgccgatcagcagcaccgtggtgaacaacgcgcagcgcagggctttttgattgtcctcgccgatgccgatcagattcaccgccgagaccagcaccatcaacacaatcggccaataccacagtccggaaaaaatccgcagtgactcctgcaaggagggctgtttcaaacgttgagccagcgaacggttgcgaatcagatgggccactggacggcgcagacgaatcaccaacagtccgaaaatcaccgaggcgatcaggccggtaaacacggcgacgctgctggtgatattgccgcccagttgacgggcgatttgcgggctggtcagcgcatcgctgagggcggcgaggaagccgatcaggaacaatggtcgcggacaataattgcggatgatgcgtgcagcgggccgtttgtgcccgacattgaacatcaccaccacgcacaacaacatcgacgtggaaaagatgccgctgctggtggcgtaggccagacacagcgccagcgcacgtccgaccgaagctggcagaaagtggctgacgtaaagcgtcagcggcaggcagatcagcgccggcacggtgtacggcaacaagtagccgatcagatcctgactgcgctgacgggtgcgcaaccagcgacctccacgcatacggttggccaacaaactgccgagtacggtgagcagcgcaaaactgccgagccaagttccagagagactaaggaaatccccggcgacgctccagcccgagcggttcgacggttgattgaccagtttgtcgacttcatcggccgcacggtcggcgcgcaggcgccaggcgtcgaccagatgttcgttgaggtcgagtttgtcctggacgtcgtcgatgcttgaactgatcgcaccgagcagaccaccctgcacaatcggttcaggtttggccgcctcctcggtggcggccgggatgcccggcaatgcggcggcgtcgatttcactggcgccgagaaacaacagtgctcccagcagaatggcgatcctgaacttgagcaaaactccgatctcccgtggctgaacctgtaaggaactgatcggtaattgcccagcaagttcaagagcaccctcaccccagccctctcccagagggagagggagctgaccgagttgcctgcgagaagtacaccgacttgcaagtccggagtcgaactcaagtcctgaatacactgaagatctgctcccttccccctcgccctctccccgcgtgagagggagctgaccgagttgcctgcgagaagtacaccgacttgcaagtccggagtcgaactcaagtcctgaatacactgaagatctgctcccttccccctcgccctctccccgcgtgagagggagctgaccgagttgcctgcgagaagtacaccgacttgcaagtccggagtcgaactcaagtcctgaatacactgaagatctgctcccttccccctcgccctctccccgcgggagagggcgctgaccgagttgcctgcgagaagtacaccgacctgcaagtccggagtcgaactcaagtccggaatacactgaagatctgctcccttccccctcgcccccttgggggagagggttggggtgagggggagcgcttttgatcttcgccttggacgtgaccgtccgtaacgccatcgaaactttcccggcccgcccgcagtcatcaaaagataccggcaacacgaggactttcgacgggagggcggcatggcgacgattcacatcggtatttccggctggcgctacgcaccgtggcgcggggacttttaccccaagggactggcgcaaaagcgcgaattgcaatttgcgtcgcgggcggtcaacagcatcgaaatcaatggatcgttctacgccctgcaacgacccgaacgttatgcacagtggtacgccgaaacgcctgacgacttcgtcttcagcgtcaaggcgccgcgcttcatcacccacatccgccgcttgcgtgacatcgagaaaccgctggcgaatttcttcgcctcggggattctggaactcaaggaaaaactcgggccgatcctttggcaattcccgccaaacttcaaattcgagcctgagcgctttgagcatttcctcgcgctattgccccacgacaccgaagcggccgctgccctcgcccatcaacatgactcgcacctgcacggtcacgcgagcatgaaagcctggcgcaaaaagccgctgcgccatgccgtagagatccgcaatgacagcttccttgatcccgatttcgtgcgactgctgaagcgctacaacaccgcactggtcatcgccgacaccgcaaacaaatggccctaccgcgaagacctcaccagcgacttcgtctacctgcgcctgcacggtgccgaagagctttacgccagcggctacaccgcgccggccctcaaacgctgggccgagcgcatcgacgcctggcatcacggcgaacaaccgaaagatgcgcatttgattgcgccacgcttgaagccgcgcccacgcaaatcccgcgaagtattctgctatttcgacaacgacatcaaagtccgcgcgccgtacgacgcccgcgatctgttgcaacgtttcgaactggacagagacctcgccaccgcccccggcgaacccgctgcgcaaggagtgctggcatgagtattccggaaccggtcggtttcactgatgaaggctcggtggtcgcgccttcggtacgtacgttcaccgtgctgacggtcaacacccacaagggcttcactgcgctaaaccggcgcttcattcttccggaattgcgcgaagcggtgcgcagcgttgccgccgacgtggtgtttttacaggaagttcacggcacccacgagcaccatcccaagcgctacagcaactggccgacgatgccgcagtacgaattccttgccgacagcctctggccgcagttcgcttacgggcgcaacgcggtgtacccggagggcgatcacggcaatgccttgctgtcaaaattccagatcatccgccacgacaacctcgacgtgtcgatcagcggccacgagaaccgtggcctgttgcattgcgtgctgcgcttgcccggtgacggcacagaaatccatgcgatctgcgtgcatctgggcctgcgcgaaagccatcgcaacgcccaattgaagctgctcggcgaacgcctcgccgagttgccggacgacgcgccagtgatcgtcgctggcgacttcaacgactggcgccaacgcgccgatgcgctgctcacaccttgtggcctgcgcgaagtcttcgccgagcatcacggcaaaccggcacgcagtttccccgcacgtttgccgaccctgcgcctcgaccgcatctacgtgcgcaaccttaaagccagtcagccgaaagtccttgccaaccggccctggtcccacctttccgaccacgcaccgttatcggtggagatcgaactatgaacagcgcgccgctggagaaatccgccgtggaaccgatagctatcaccccgccgatacgcgagcccggccaagtcgatgtcgaatatcgctggcagggcaacaatcatgtgcagctgctggaaaacggtgaggagtatttccctcgcgtgttcgaggccatgcgcgcggcgaaaagtgaaatcctcctggagaccttcatcgttttcgaagacaaggtcggcgccgaactgcaggagattctgattgatgcggcgaagcgcggcgtgcgcaccaccgtcagcctcgacggctttggctgcggcgagctgaccaccggctatctcaccgcgctgagtgcggccggcgtgcatttgcagatcttcgatccggcccccaaacggctgggcatccgcaccaattggtttcgccgtctgcatcgtaaaatcgtcgtggtcgatggcatggtcgcgttcatcggtggaatcaatttttccggcgatcacctggccgatttcggccccgaagccaagcaggattactcggtggaagttcagggcccggcggtggccgacatccaccatttcgccctgctgcaaagtggtcgcccgggccgcgcgcggttctggtggcagcgccgccgccagcgccgcgccgaaatggctttcgacgaccatgacggtcaggtacgtctggtgttccgcgacaacgaccagcacagcaccgatatcgaagacgtttatctgcaagtgctgcgccgcgccaaacgccgcgtggtgatcgccaacgcgtatttcttccccggttaccgcttgctgcgggaaatccgcaatgcggcgcgacgtggtgtcgaggtgcgactgattctgcaagggcagccagacatgttggtggccaaactcgcggcgcgcatgacctacgattatttgctcaaggccggagtgcagattgacgaatattgtgcgcgcccgctgcacggcaaagtcgcgcttgtcgatgacgaatggagcaccgtcggttcgagcaacctcgacccgttgagcttgtcgctgaacctggaagccaacgtgctgattcgcgaccgcgccttcaatcagcacttgttcgagcgcctcgaagacctcagccagaatcactgcaaggccatggatgcgagcaagtcgccacgcgggcggatctggcacatgaccgtggggtttctggtgttccactttctgcggcacttcccggcaatggccggttggctgccggcgcacaaaccaaggctcaagccgtttcgaggtgaccgctcatgagccattccgaggtgcattccgcccagcattcgacgcctgcgacgcactcgaaatggagtcgctggaaacgcccgctgacgctgctgttttttctcgcactgatcgtgttgctgacgatgttcgccacgcgcatcgaatgggccgaagtgctgcagaccctcgccgacttcaaagtgcgcacgctgatcatcgcggccagcctgacgttgttgagctttctggtgtacgccagtttcgacctgatcggacgcacctacattcgccaggatctgacctggaaacagatcctgccggtggggatcatcagctacgcattcaatttgaacctgagcgcgtgggtcggcggcattgccatgcgttatcggctctactcgcgccttggggtgagcaaaagcaacatcgccaagatcctcggcctgagcctggcgaccaattggtttggctacatgaccattgccggcgtggtgttcagcagcggtctggtgagcatgccgccggggtggaaagtcagcagcaccgcgctgcaaggcatcggcgttttactgctgctgatcagcgccggctatcttgcggcgtgccagttttccaagcgccgcgaatggtcgattcgcggtgtggagatcaatctgccgtcgctgcgcatggcggtattgcaactgttgctgggcgcattgaactggtcgttgatggcggcggtgattttcaccttgctgccgagcaagctcgactacccgttggtgctgggggtgttgctgatcagcgcgattgccggggtcattacccatattccggcggggcttggggtgctggaggcggtgtttgtggcgctgctgcaacacgaggcttcgcgcggcagtctggtggcggggttactggcgtatcgggcgatttattttctattgccgttgttgattacggtggtgatgtatctggtggtggaggccaaagcgaaggcgctgcggatagagaagaaaccgaggcattaagatcaaaagatcgcagcctgcggcagctcctacagttggaatgcattctccctgtaggagctgccgcaggctgcgatcttttgatcttcaggattggataatgctcaaccgctcaccaacaaccatctcggtaatccagtccaccagaatcgaggtgtaggcctgctgcgacaccggttcactcagcgcatgatcggcgccgtcgataatccggtgcgtcagtgaatgagtctgctggcatgccgcgcggtaactcatgatcgccgcgtggggcacgtagtcatcggtttccgactccaccagcaacacatccccggtgaactgcgaacacgcatgcagcgcacggttgctgtcggcgcgcaccagcgtgcttcgataatcacgcaagtcggccttgtccagctcacgtttgggcgtgtgccattgctcatcgcgatacagcgctggcacgcgcaacgccagccagcgcaccgggcgcaatgacgtaaggatcgatgccaggtaaccgccataactggtgccgaccacggcgattgccgaggtatcgagcgccggatgcgccagcaagcggtcatacgccgcgagcagatcgcgcaagttgtcttcgcgggtgacgcgggtcagcggaattccggtgccgccggtatgcccgcgcaagtcgaacgtcagacatacacaaccgagaccggcgatacctttggctcgctccagatcgcgctcctggctaccgccccaaccgtggacaaacaacacccccgggactttcgatttgggactgagaaaggtcccgctcatctgttcatcatcaatgtcgatttgaatgctttcgcttctagccgtcataggatttgaccgttacgtatttgaggagaaattcactgttttcggccgggccgcgatacacctcgatggcattcgccggcagcggttgatcaatgtaggtttccaccgaagacacgcgaatcgcgcgcatccccgggtcgttgacgaaactttgcagcgcggcgacttcagcgctgctggcgccacccatgcgccaggattgttcgagtacaccgctgcgggttttgccgttgctgtccagcccttgggcgatgtcgtagttgcggcgcgaggcgtagaaacgtgggtaggcttcgtcggcggcactgtcgaaaatctgcgcctgttcgatggccaggcgcacatcgtccggtaaatccagcgccagcagatcgtcatagccaccctgcaccaccagcaggttcgagccgccataaacctcttcctcgtgggcgtctttggtcaagtattgatcaccacaataactcaacactttgtcgccgatgaatgactggccgacgctgtgagtgaccacatcgctcaagtcctgctccagcactacgccctcactgaagtatttttcaatgtcgggacgggcgaggacttcgtcgaaggcgtccaggctctttataacttcctgaccgcgaccggcacaggcgtgaatcggcttcagacgaatcggcccgctgtacagcaagtgctcggcagcgggccgtgcatcttccagagcaaacacgctgagaccgtcgaggaccacattgcgcgtgcgttcgctgaacagcggcgaccagccttgtggcgcggtggccaaatggctgcgcagaccgtggctgatggctttggtgcaaatgaagtcatgttcgacaaagccgccccacagatcctccgggcccttgatgcccagcgcctgggcctgggcagcgccgacgatggtttgcgtgggcagcagatacagatcacggccgcgatgtttttccgggtcgtaactgccaccgaatttcaacccgagaatctgcgccagccagcgggccagcgccttgttggtttgcacttcatgctgcggcgcgtcggcacgcaccgagtgggcgacgacgatttttttgcggggtgtcggggtcatgcgtcccccttccatcggatcggtgactgtagcggtggagggtgcagagatcaggccaacggcggttctagtaaaatcatagaccaatcagaaacttgccagcagggtgctggcatcacgcctgtttcaatctgcacgaacgcctgcaaaaccccggcaaattgcacgatcccgaaccttgtgcggtctcttgtaggagtgagcctgctcgcgatagcggtgggtcagtcacctcacggttttctgacagattgctatcgcgagcaggctcactcctacattagatgttcgttgctttcaggatcggggtcacaccaaaccgcgcccgataatcactcggcgccagcccggtgattttcttgaaaatcgcgcgaaacgctcctggatcctgatagccgaccgtccaggcaatgtgatcgatggtgccattggagaactcgagcatttcccgcgccttgcccacccgcaagtgctgacaatactcggtcggcttcaaccccgtcgccgcgcgaaaacggcgcaggaatgtgcgctcctccagccccgcccgctcggccattgtcgtcagcgaaacatccgtcgcgccagtgctttgcagccaatgttgaaccttgagtatcggcgcgtcaccatggctcagaatcggtgcgaaattactcccgcactcgctcgcgctgtcgctgtgctcgatcaccagaaatcgcgcagtggcggtggcgatgctcggcccaagcagacgatcaaccagacgcaagcccaattctgaccacgccatcaatccagcggtggtgatcagatccccgtcatcgacgatgggcgtatcagccttgagtttgatcttcggataacgctcggcaaaagccttggccgacgtccagtgcgtagtagcgctacggccgtcgagcagaccgctttcagccaacatcagcgagcctacgcaaaccccgcccagcgtcgccccgttggcatgctgagcgcgtaaccattgcatcaggctagccggtgcctgcgccgccgagaacccgccgatcgatggcggaatcagcaccgccagcaaagcgctgtcgtcacccgcatgactgtcgtaagtgcgcattggcggctgatcgccctcgacctgccaatgactcactcgcagcagcggcagttgcgcagcctgatactcggcagcaatccggttggccaccgcgaacagatcggtcaggccatgcaccgccgccatctgcgcaccggggtaaatcaatatgcccagttcagcgacagcggccctttctacgcccattgtcagttttcccctgcttattgtcggtgcggccaatcctcgattcgctggtcagcgtcaatactgaagccacttccagccaatccatcgaggacacacccatggccaagcaagcgctcatcgtagtcgatatccagaacgactacttcccccaaggcaagtggccgctggccggtgctgatgccgccgccgacaacgctgcgcggctgatcgcagcgtttcgtgagccaggcgattcagtggtgcatatccgccacgaattcacctcccccgacgcaccgtttttcaccccgggttctgaaggcgccaagctgcatcccaaagtgctcaaccgcgccgatgaacctgtcgtgctcaaacacttcgtcaattcattccgcgaaaccgaactacaagcgatcctcaacgagaaaggcatcacggaactggtggtggtcggcagcatgagccacatgtgcgtcgacggtatcacccgtgcagcggcggatctgggctacagcgctacggtgattcacgacgcctgcgccagccgcgacctggagttcaatggccttaccgtgccggcggcgcatgttcacgcagcgttcatgtcagccttgggttttgcctacgccagcgtggtgtccaccgacgaattcctcgcaaaacctcactgagtcataccttgcaaactatccgggcccgccttccagcgggccttttttcgtctgtcataaaaatctcacgcgtgagccattgatggcactttgatttggttgtagtgtggctcacgcgtgagatgttcataaccgagccattgccatgaaaagccgttcccccacatcgaaatcagaaagcccgaagggagagcgcgcgaaaccgtcggcgaaaaaaccgtcgagcttctatatgaagcagatgcgcgcaggcctggccgctgccggttatgtgaaacacgaaacttgggtgcttcccgaaaaccgaagcttgctcaagcaaatggagcaacagctacgccaaccgattctggctggctctttcatgtcggagaattacatgagcgcaggcaacaactggaccatcgatagcctcttcaacgccctcaaggccctggacgaggtggcttcgcaagagatcacgctgtcgctgatccagagctccgaacccagcatcaagctggaaatgaacgaattcggcggtctgccgattcacatcgccttggctggccagcagatcatcgtcgacaccgtgctggtggacatcgattcgatctcggacgtagcgactttcaacgacgccgtgttgcgcagccgggaaatgttcccgctgtcctcaatcggtatcgagtcgatgcccaacgggcagaccgtttacaacatgtttggcgccctcagcgccgactcgagcctgaccaacgtcgtcaccgaggtgaaaaccctggtcgacaacgtgcagcgcgcaagcgaagccttcgaacacttcttcaagtaatcaacagggaatatccaatgactcagtccatctggagcaagttgttcaccgcactgcgcggcggcgccaatgaagtcggcgaagcaatcgtcgaccaacaggccctgcgcatcctcgaccaggaaatccgtgatgccgacagcgcgctgtcgaacgcacgtcgcgaactggtcaccatcatggccaagcacaaactggctgctgaccgcgtgagcgagtacgacgccaagatcaaggatctcgaagccaaggctgtttcggccctgaacgccggtcgtgaagacctcgcgctggaagtggccgaagcgatttcgaccctgaccaacgacctcgacgccgagaaaaaacagagcgacgagttcggcacctacgccgaaaacatgcgcaaagacatcagcaaggccgaggcgcggatcaagagcctgcgccagcaagtggacatggccaaggcccgtgaaagcgtgcagaaagcccaggtcagcgcatcgattgccagcggcggcgccaatggcaaactggaaaccgccgtcggcactctgaatcgcctgcaggccaagcagcagcaacgcgccgccgagctgagtgcagctgatgaactggccgacgcctcgaccggcaacgacctggatcgcaaactgcgcgacgccggcatcacaccgaacgaaggcagcgccaacgcgattcttgagcgtctgaagcaaaagtccgctcagtaatcactgcgaaaaacccttgtaggagtgagcctgctcgcgatgaggccggaacattcaacctcagtgttgtctgaaccggcgcaatcgcgagcaggctcactcctacttgttttgtggcgtgttgttgatcgcgcagcccggtacactagccacgctttttcgccgacgaacacttccacccgcttcaaggaacgtacccatgggatggtttaaagacttgctgggcaccagcaactggcagaacgctgcgccaacaccgaccgttgccagtggcccactcggcatggcgcagggcaaggccgtcaggttcgatacgacgctggcgctgttgctcgacggttcgaccaccgtgcgcgtgccctttgatcaggcgatctggagccatggttgggtcgacctcggccagtccaacaaactgcaccgctattacatgaacgacgaggatttctggctgcagatccacgtcaccggcggcgaccagatcgaatcggtcaccctgttcaactacctcagttacgtgaccgtcaacagtgacgccgaactgcagcgcctggcgggtccaagcagcccgatcggccttccggcttacacccacgacggtgtcgggttcacccgcgaatggggcaccgagcaaggtcagaccgaactcgtaccgatgaccgagcaagtggtcaacccggacgaaagctacaccatcgaacaccactcgatgctttacgcccgcgacactggcctgaccgatcgccgcgaattgctgctgttctccgtcgaacaggacgaagaaggcaccgtcagcttgagcacctctctgggtatctcgctgtacacgactgatttgagcaccatttaaaaaggaagtttttcatgctggaagtgctggccgtttccctgaacaagaccgcactggtcggtttcgtcgtttacctgatcggcgccgtgctgctgttcatgctgtttcaattcgtctacacacgcatcaccccgcacaaggaattcgagctgatccgttccggcaacagcgccgcggcgattgcgctgtccggcgcgatcatcggttttgcgattccggccagtaacgtgatcgccttctcggtcaatgtcgtcgacttcgtgctttgggcggtgattgcggccgttgtacaactgctggcatttctcgccacaggcctggtcctcaaaggcacttcccagcgcatcgccaacggtgaagtggcttccggcatttatgtcgctgcggtggcgatcagcgtcggcatgctcaatgccgcctgcatgacaccgtccaactgaccggcaggaagccctcgatgaaacgcagtaaatacgttcagttgtccctcgccgcctcggtggccctggccatctccggcgaagcggtagcagtcgatcagccacgcagcttccagagtgtcgagcagtgtgtcgatgccgaagtcgccgccgatgtctgctcgaacgcctacgtcgccgccctgaccgagcaccgtcgtatcgccccggcgtacgatgacaaggccgagtgcgacgcagactttgccgccgactggtgccagaaaaattcgtccggcaaattcgtgccgaaactgggtggcttcaaaatcagccagaacgctgaagcgccgcagaatctcgatgcgattgccgatgcgcagatgcccgctggtgacgtcaacgccgcacaagccgcacaggccacgactcattcttccgctagctcgaccagcggcctgctcacgggatggctgatcggcaacgcgatgagtaacaactccaatcgcacggtttatcgtgatcgcgacacacgccagacctacaacacctcgacgcagtaccgcaaagtcgaatctgctccggtcacgcgcagccagcctgactatgagagcagcaagagcaaaccggtgaacgtcgcctcctcgacttcccgtggcggtttcggcagccagtccagtgcccgcagcgggtggggtggctggggcagcagttccggccgttcgagcagctgatcatgaaaaagatccactgcgccgagcgccccgactggaaacacaccgccgagagtctcggcttcatgttccataccatcgatgacgaaccgtactgggacgaaagcgcctactaccagttctcgctggcgcagatcgaaaacgatctcgaggatccgaccaccgaactgcacgagatgtgcatggacctggtcgaccgcgtcgtgcgcagcgaagagttgctcgaccgcttgagcatcccggcgtcgtattacgacatgatccgcacctcctggctggaaggtcatccgcatctgtacgggcgcatggacttttcctacagcggtaacggcccggcgaaactgctggagctcaactacgacacgccgaccagcctctacgaagcggcggcgttccagtggggctggcttgagcaatgcatcgaacgcggtacgctgccgcgccatgccgaccagttcaacagcatcgacaccaaactgcaccaggcctttgccgagttgcaactgaagcggccgttttactttgcgtcgatgaaagactcggtcgaggacaaaggcaccacggattacctgcgcttgatcgccgaaaaagtcggtatcgaatcgcgacacatcgacattgaagacatcggccttacggctgaaggtcgctttgttgacctgcaagatcgctggatcccgcacctgttcaagctgcatgcctgggagttcatcttccacgaaccgttcggcgcggcgattgccgagtgcgacacgcagtttttcgaaccggcatggaaggcgatcctgtcgaacaaaggcgtgttgccgttactgtgggaaatgcacaaggggcatccgaatctgctggcggcgcacctcgacccgaatccggccaatgcagtgcccaagggttgggtgcgcaagccgtacttttcccgcgaaggtgccaacattgaactgcagaccccggacggtttgatcgtcaaggaggatgggccgtacaccgacgcgccgtttatcctgcaggagtttgcgccgctgccgaagtttggcgacagctacacgctgatcggctcatgggtgattggcgatcaggcggcggggattggtgtgcgggaagacaacagtttgatcaccaaggattcgagccgcttcctgccgcacctgattcttgactgacaatacatctgcgatgaccaagcgacgaaatacaccgctcgatcattcgaaaatgtaggctttctccgtgcagaacgcgcggggcaccattatctgaggcacatacaaaccgttgatcagacaattgtagtcagcggcggttaggggcgtttcgggttgcccgtagttgaggaaaccgtacgttgcacaatcaatcaataccctcaatgccagagcttcttttatgtcgtctcgcagaaacatctgctcagagcgcgtatcaaactttctgacctgtatggttgagcctcctgcaaccgtctttgtttcgcagtgcgccaccaagttcttcacaggaatagcaccaaaacccaagcctgctgcggtcattgggtcgctaccaagtgtcagacgattcgagccaatctttgcattgcaagtatccagatcccccaaagtgaggatagacgcaaagggcaactgagcaaaatcgactaaatggcagacattgccgaaacgcgacccgacttttttaggacgggtgactgcgtcgttttcgcggggctcaatggcgagaaaaacatagtcggtgtgaccgatattcttgaaagccatgctgggagtattacccttcggataatctttgatacccaactcgcctgagaattgatcgagaaaggttcggctgtataacgacaacgtatgagtctgcggcccctgcgcagtttttttagtttgctttcccttgggttgttcatgtacacgcgaaaattcagcgtagtgggttaatgacaaagggaaacgcttgaggcactgaagcagatcatccgaatagggcagcttttcagccgcctcctttcgaagcttttccaggttggcgctcgaaatacaacccaaagcgttcaatgccgcgaattcattatgaaggtgatcattaaggtggcaactgaaagcctgcactaaaggctctttggtcaatgactctgctggggtctccctgattgtctgtaccgtcgtcgccggcatttcggtaaggggccggtgttgcacggccgacgtcgatgctgaaggtttgggcgcactggaactggcgctttcctccgcggaggaggcaacattgcgcctcgcacgtaaattgacttcgggcaatatccactgggcaccctgcgtcaacataaaccgcgcggcatgctcggcagccctcatgcaggcggtgtcggaggtaagaaccttgtcggcaagattgtaaagcgtatacaaggcagcagccgtcaccttcggtgagcaggcacccttcaatcggttgaggcgttctgcatcgccttcttcggccaacacatctaccgtggagtgaacgacttcgcacagggggcagcgcctgtcgtcgatcgtcgctccattcatacccaagggtgcttgcttgtgctcctcttcctcattgtcataggcgcgctgttgctctttcgtcatcatgatccgtagaccctcttcagcgcagatacgaatgctttctccgttgcgtctccatcggccgtgattcggttatcggtctggaaggctgccaccgctgaatgcaacgcctcgtcgatcatttcatcgatggttccagtgtaataacccaacgactgcagccgccccttcaccccgctgaccgtgtcaattggattgagatgactgacccgaaaacgatgcacctcggcaagagccccctgccccagcgtcaccttggccaacgtgatcgccggagaaacaaacgcgaggatgtaaccgtcgcgatcgatgacgccgcaacgatcgacatatgcagcaccatcggctgatgtcagcgccaattgatagggttcatctacgcgagccctgccattgcgcaagaagcgaaggcgcaacacttcgggaatgcctttgcgcttcaagacatagcgccgcccgacaatcccatcgatccgtttcgattgtttttcggggatatagatttcatcgccccgatacagcacgttctgatcccgtcgtttatccgcaaggtccaggttgcgcttgtgcccccatatcgttgcggggaaaaaaccgaaccgatgggccagtctggcgatacattccccttgaatggcggaatgcgtgaacgctgggtgactcgttggtgcaagtggccgccaatccggctcgctggcggtcaccgtgctcatgatcaaagcgctcgttccggccggctcccaggcaccggcgtccagttcggtcaacccgatctcatagctgccgtgatcgagaggctcaaagcgagcaacaccgtcgagccgcgtacgggatgtcatcacttgcgtagcacctttcttcaactcgacagcaacgccttcgagcggagcaccatcttcgccaaccacctgtacttcaatggcttgacggaggtttgatctggccgcacaagaaacggcaatactatttgaatgagtctgcggcaacgccattgcagcgccatctgcattcgccagtgaactgatttgcgtcatgtcccttgtcctgtatgaggtcgctgcagcagatcgcggtcccagatcgactcatcatccatgtgcgtagccgaaggctgccaaggctgagtatcgctgtcgaattgtcctcttgactcgcgattcctgcgctcaacgtcttcgcggtagagcgccaactccagcgctcgccccattcgcgcactggggcttccacccaattcgtctgtcaatacttcacgaacccagcgcgatgcaggctcatcaggaaaatctctgccatagatcgcggccagactcacgaaacgacagcagtcacgctgagagtacaggccaaagtcgtttgccttacgtaacgacgcacgtaccttttcagacaacatcacgtcgtcgtcagccgcatagcgttctggaaaatagatgcgtaaatgcaccaccatcgtcgagacatactgtgcgttagcctgaagctcgaacgcctccagttgagaccgtcgcaccaagtgcgtcatagcgtccgcctcattgattttgagtagacaagcgactgactgcagcccgaaccgccgcagtaaaatccggccgaatcaagtgcccgccgggatacgtgatttgtagcgaggacgctgctgtgaaggcaatccagttgacgtgcgaaagccaactgctggatgaggtctaaagcttggccggcatatccgttgccgcgatatcggagactgatccagtatgaaaaatggccgtcccttcccaaggtaatgaaacccagaaaaccacattgttccgggtttaccagtgcatacaccgaaacatccagggaatgtcgcaaccagtttatccaggcacgcagctctgcagatgaaccaaaacaagggtatccggcgcaatgactaccttgcggatcagccttgatagcggtaaatgcatgctggctgtggtgcggaccgaaaggtgtggcgatgatgtctgctgctatgagagttgctggcgcaagaggaccttcgcaggcacgcacccaggcgtccagccgtgacaacatgtcggagtacagcgaattcgtcggtgccagcctgctggcatgttgccaatatcttcgtgcttgtgcatgacgcgccagctgccagctggccaatgccaaattgtgcagcgtgattgcatccggcgcagtcgacgagaggttttgttcgtattcagcaatgcagtctgcccagcgattttgccgagcacatgcgaatacagcgttagtaagcgccacgcttccttgcactcgaacatctcccaaaccactggttggatgctgagggctatcacagcctctcaacaccgcgcgcataccctcgcacgatcaagatagctggcactggtaaaagcgcaaatagcaaaaagcccggcatccttgaaggagtgccgggcttttttcgtgtcagacgcagtattcgtcagaacggaatatcgtcatcgaagctgtcgaaatccggagccggttgcggtgcggcctgctgtggagccggggccgaacgctgttgtggagccgactgctgaggacgcggagcctgctggcgcggagccggagccgactgctgatagttgttgccgccaccttgttggtcgccctgttgtggacggccgccgagcagttgcatggtgccttgcatgtcgaccacgatttcggtggtgtaacgcttgataccgtctttttcccactcgcgggtctgcagcttgccttcgatgtagacctgcgaacccttgcgcagatattcaccggcgatttcggcgactttgccgaacatcgaaacacggtgccactcggtcttctcgaccttctgaccggtttgcttgtcggtccactgttcgctggttgccagactcaggttggtcacggcgttaccgttaggcaggtagcgaacttcgggatcctggccgcaagtgccgaccaatatgactttgttaaccccacgggccataacgttctcctaggcttcgcaagcagccccggccgggttgttcaccaggcgttcgagggtgtcgcgatccactaattctttgtccagtttgatgtaaacagccgcttcgtcagcaactatcactgcatcggttacccctacgagggccttgaggcgctcgaccagacccgcttcgcggatcgcctcgggcgacaacggcaagcgcaggctcgtcacgtagggaggttcacgcatggtaacagcaaaggccagccagatggcagccagacccgcgcatccaaggaacacaaccgacagaccgccatgctgaaacagccagccgccgagtatcccgccgagtgccgaaccgaggaactggctggtggaatacacgcccatggccgtgcccttcccgcctgccggtgaaaccttgctgatcagcgacggcaatgaggcctccagcagattgaacgcggtgaagaacaccaccgtaccgatcaccagagcccgcaggctgtcgccgaactgccagaagaatagctcagtcagcatcagcgtcgtcacggcgccgagcaaaactcgtttcattttgcgtttcttctcgccatagatgatgaacgggatcatggcgaagaacgaaatcagcagcgcggtgagatagacccaccagtgctgttccttgggcaaaccggctttttccaccagtgccagaggcagcgcgacgaagctcgacatcagcatcgcgtgcaacacaaagatacctaaatcgaggcgcagcagatcggggtgcttgagcgtcggcatcaaggcctgacgcgctacaccagattcacggtgagtcagcggaccggtcgatttcggcaccatgaacatcacaatgacgatgcccaccagcgccatgccaccggtggcaaggaacaaccccgacagaccaaacgcgcgggtcagcaatggtccgacgaccatggccacggcgaacgacaggccaatggtcatgccgatcatcgccatggctttggtgcggtgctgctcgcgggtaaggtcggaaagcagagccatcaccgccgcggaaatggcgccggcaccttgcaggatccgtccggcgatcacgccccagatagaatcagcctgtgaagccagaacactgcccagagcgaagacgatcagcccgaggtaaatcaccggacgacggccgatgcggtcggaaataaccccgaacggaatctggaaaattgcctgggtcaggccgtaggcgccgatggccaagccgatcagggccggggtcgctcccgccagatccatgccgtaggtcgccagcaccggcaacaccatgaacatgcccagcatacggaaggcgaacaccagggccagaccgctcgccgcgcgggtctcgctgccactcatgcgttcgctgtggggatcgtgcatggaaaaacctcgtgtgaaccggcggcgattctaccagtcccatcgaaagacggggtagatcgcgacgctttgacgcgtatagatgaaactctcttcatccaaggcaaaaaacccttcgtttgatagtgtgcatccatccagtatttgcccgtatactcctacgttttcgacgcccgccgagcgaggccactttggacaagatcctgatacgtggggcccgtacccacaacctgaagaacatcgacctgaccctgccacgggacaaactgatcgtcatcaccggcctgtccggatccggcaagtcgtccctggctttcgacacactgtacgccgaaggtcagcgccgctatgtcgaatcgctgtcggcctatgcccgccagttcctgtcgatgatggaaaagcccgacgtcgacaccatcgaaggcctgtcgccggcaatctccatcgaacagaagtcgacctcgcacaacccgcgctccacggtcggcaccatcaccgaaatctacgactacctgcgcctgctctatgctcgcgtcggcacgccgcgctgcccggatcacgacattccactggaggcgcagaccgtcagccagatggtcgacctggtgctggcgcagcccgaaggcagcaaactgatgttgctggccccggtgatccgcgagcgtaaaggcgaacacctgtcggtcttcgaagagttgcgcgcgcaaggtttcgtccgcgcccggatcaatggccgcatctgcgagctcgacgagctgccgaaactggataaacagaagaagcactcgattgacgtgatcgtcgaccgcttcaaagtgcgcgccgatctgcagcagcgtctggccgagtctttcgagaccgcgctgaaactggcggacggcatcgccctggtcgcaccgatggacgatgagccgggcgaagaaatgatcttctccgcgcgcttcgcctgcccgatttgcggccacgcgatcagcgagctggaacccaagctgttttccttcaacaacccggccggcgcctgcccgacgtgcgatggcctgggcgtgaagcagttcttcgacatcaaacgtctggtcaacggcgagctgaccctggccgagggcgcgatacgtggctgggacaggcgcaacgtctattacttccagatgctcggctcgctggcatcgcactacaagttcagcctggaaaaaccgttcaatgaactgaccgccgagcagcagaaacagatcctgcacggcagcggttcacagaatgtcgacttcaagtatttgaacgaccgtggcgatatcgtcaaacgctcgcacccgttcgaaggcatcgtgccgaacctggagcgtcgctaccgcgaaaccgaatcggcgagcgtgcgtgaagagttggccaagttcctcagcactcagtcgtgcccggattgccgtggtacgcgtttgcgtcgtgaagcgcgacatgtatgggtaggcgagaagaccctgcctgcggtaaccaacctgccgatcggcgatgcctgcgtttacttcggcgagctgaagatgactggtcgtcgcggtgaaattgccgacaagatcctcaaggaaatccgcgagcgtctgcagttcctggtcaacgttggtctggattacctgtcgctggatcgcagcgctgacacgctgtccggtggcgaggcgcagcggattcgtctggccagccagatcggtgcgggtcttgtcggtgtcttgtacatcctcgacgagccgtccattggcttgcaccaacgtgacaacgaccggttgctcggcacgctcaagcaccttcgcgatatcggcaacacggtgattgtggtcgagcacgacgaggacgcgattcgcctggccgactacgtggtggatatcggcccgggtgccggtgtgcacggcgggcagatcgttgccgaaggtacgccggccgaagtcatggcacacccggactccctgaccggtaaatacctgtcaggtcgggtgaagattgaagtgccggccaaacgcacgccgcgcaacaagaagctgacgctgtcgctcaagggcgcacgcggcaacaacctgcgcaatgtcgatctggaaatcccgattggcttgctcacatgcgtgaccggcgtgtccggctcgggcaaatcgacgctgatcaacaatacgctgttcccgctgagcgccaccgcactcaatggcgcgacgacactggaagcggcagcacacgacagcatcaaaggcctggaacatctcgacaaagtcgtcgacattgaccagagccctatcggtcgtacaccgcgttccaaccctgcgacatataccggtctgttcacccccatccgcgagctgttcgctggcgtacctgaatcacgctcccgcggctacggcccggggcgtttctcgttcaacgtcaagggtggccgttgcgaagcgtgtcagggcgatggcctgatcaaagtcgagatgcacttcctgccggacatctacgtgccgtgcgacgtgtgcaagagcaagcgttacaaccgcgaaacccttgaaatcaaatacaagggcaagagcatccacgaaaccctcgaaatgaccatcgaggaagcccgggtgttcttcgacgcggtgccggcgctggcgcgcaagctgcaaacgttgatggacgtcggcctgtcgtacatcaagctcgggcagtcggcgacgacgttgtccggtggtgaagcacagcgggtcaagttgtctcgtgaactgtccaagcgtgacaccggcaagaccctgtacatcctcgatgagccgaccaccggcctgcattttgcggatatccagcaattgctcgatgtattgcatcgcctgcgcgaccacggcaacaccgtggtggtgatcgaacacaacctcgacgtgatcaagaccgccgactggctggtggatctcggccctgagggcggttcaaagggtgggcaaatcattgccacaggtacgccagaggaagtcgccgacatgaagcaatctcacaccggccattaccttaaaccgctgctgatccgcgatcgggcttaaacgtcagccatgaaaaagcccctgtcacttcaacagtgacaggggcttttttgtatcttctgcaatcaggaagtgtgggactgcagatagttctcgagaccgatcagcttgatcagacccaactgcttttccagccagtaggtgtgatcttcttcagtgtcgttgagctgaacccgcaaaatctcgcggctgacatagtctttgtgctgctcgcagagttcgatgcctttgcacagcgccgcgcggactttgtactccaggcgcagatctgcttcaagcatctctggcaccgtgctgccgacatccagatcatccgggcgcatgcgcggggtgccttcgagcatcagaatccgacgcatcaatgcatcagcgtgacctgcttcttcttccatctcgtggttgattcgctcgtagagtttggtgaacccccagtcctcatacatccgcgaatgaacgaaatattgatcacgcgcggccagttcgccggtcagcaacgtgttgaggtaatcgattacgtctgggtggccttgcatcgccctacatctccctacttgaaagtctgtagtttgaaccaacctgactggaaggtcacccgtcacacgcaataaaagcgaagatattcttagaaaagcagcctaaataacgcaaaaaccgcccaaatgagggcggttctgcttctcgtttagacttcgttaagctgtacgttgagcagctttgcgattgcttctccatacgccggatcggctttgtagaaatgctgcaactgacggtcaatcacatcgctcgaaacgccagccatggcgccggcgatgttattcaccagcagcgccttctgatcgtcgctcatcaagcggaacagcgcaccggcatggctgtagtaatcggtgtcttcgcggtgatcgtaacgatcagccgcgccgctcaaggccagcgcaggctcagcataatgcggagcttgtttgggcgattcgatgtagctgttcggctcgtagttgggcgctgcgccgccgttgttgccgaacgccatcgagccatcacgctgataggtgttgaccgggctgcgtggcgcgttcaccggcaattgctggtgattggtaccaacacggtagcgatgggcgtcggcgtaagcgaagacgcgaccttgcagcatgcgatccggcgacagaccaacgcctggcaccatgttgctcgggccgaaagctgcctgttcgacttcagcgaaatagttgagcgggttgcggttcagttccaactcaccgacttcgatcaacgggaattctttctgcgaccaggttttggtcacgtcgaacgggttctcgcagtgcgccgccgcttgcgcttcggtcatgatctgaatgcacacgcgccatttcgggaagtcaccgcgctcgatcgcctcgaacagatcgcgctgggcgtagtccggatcagtacccgccaagcgtgcagcgtcggagggcgaaagattcttgatgccttgcttggttttgtagtgccacttcacccagtgacgctcaccttttgcgctgacaaggctgtaagtgtggctgccgaagccgtgcatgtgacggtagccgtcaggaataccgcgatcggagaacagaatggtcacttgatgcagcgcttcaggcgaatgtgaccagaagtcccacatcatctgcgcgcttttcaggttgctttgcggcaggcgtttttgcgtatggataaagtcagggaatttcagtggatcgcgaatgaagaacacgggcgtgttgttgccaacgatgtcccaattaccttcttcggtataaaacttcagagcaaaaccgcgcggatcacgttcggtatcggccgaaccacgctcgccacctacggtagaaaagcgcagaaacgtcggggtttgtttaccgaccgagtcaaacaatttggcgctggtgtactcggtgatgtcacgggtcacggtgaatgtcccgtaggcgcccgagccttttgcgtgcacgcgacgctcaggaatgttttcacggttgaagtgagcgagcttctcgatcagatgaaagtcgtcgagcagcagcgggccacgggggccggcggaacgagaattctggttgtcagcgacaggtgcgccactggcggtcgtaagcgttttgatctggctcatacggtcttcttcctctgtcagtcttgaaactgccggctaatcggcttgctgggaagtattgatcatcaatgtgacagccacaaattcattaacttgtgcttatcgatagaaaattactaattatgattcccaagccatagtgccagctgacctgtgtcagaagcttgtacgtaaagcgcattttcttgcaggcacaaaaaaccgggcactaggcccggttctttgtttcagactgacgtcttactcggcggatacagcttcgccagcagtagcacgatcaaccaactcgacgtacgccataggcgcgttgtcgccagcgcggaaaccgcacttgaggatgcgcaggtagccaccctcacgggtagcgtaacgcttgcccaggtcgttgaagagcttaccaacgatagctttcgaacgagtacggtcgaaagccagacggcggttagccaggctgtctgtcttggccagagtgatcagcggctcagcaacgcgacgcagttctttggcttttggcagagtagttttgatcagctcgtgctcgaacagcgacaccgccatgttttgaaacatggccttgcggtgcgagctggtgcggctcaggtgacgaccacttttacgatgacgcatggttcattccttaccaaacactacgttcggtgattacgacgatcaggcagtcgccttgtcgtccttcttaagacttgcaggcggccagttgtcgaggcgcatgccgagggacagaccgcgggaggccagaacgtccttgatttcagtcaaggatttcttgcccaggttcggagtcttcaacagctctacttcggtacgctggatcaggtcaccgatgtagtagatgttttccgccttaaggcagttagccgaacgtacagtcagttccagatcgtcaaccgggcgaagcaggatcggatcgatctcgtcttcctgctcgacaaccactggctcactgtcacctttgaggtcgacgaacgcagccaactgctgttgcagaatggttgcagcgcggcgaatagcctcttcaggatccagagtaccgttggtttccagatcaataaccagcttgtccaggttagtacgctgctcgacacgggcgttttccaccacgtatgcgatacggcgaaccgggctgaacgaagagtcaagctgcaagcgaccgatgctgcggctttcgtcttcatcgctctgacgcgagtcggctggttcataaccacgaccacgagctacggtgagcttcatgttcagggcgccgttagacgccaggttagcgattacgtgatcgggattaacgatctcgacatcatgatccagctgaatatcggcagcggtaaccacccccgaacccttcttcgacaaggtcagcgtaacttcgtcacgaccgtgcagcttgatggccagacctttaaggttcaacaggatttcaattacgtcttcctgtacaccttcgatggcgctgtactcgtggagcacaccgtcaatctcggcctcgactactgcgcagccgggcattgaggacaacaggatgcggcgcagcgcgttgcccagggtgtggccaaaaccacgctcgagaggctcgagagtgatcttggcgcgggttggactgacaacctgcacatcaatatggcggggtgtcaggaactcatttaccgaaatctgcatggatgcacctattttctagcccttacttggagtagagctcgacaatcaggctttcgttgatgtcggcggacagatcactgcgagcaggaacgttcttgaaaacgcccgacttcttctcagtgtctacttctacccattctacgcggccacgttgggcacacagatcgagagcttggacaatgcgaagttggttttttgctttctcgcgaactgcaaccacgtcaccagcacgaacctgatacgacggaacgtttacggtctgaccgttaacgctgatcgacttgtgcgataccagctggcgggattcggcacgagtcgaaccaaagcccatacggtatacaacgttgtccagacggcattcgagcagttgcagcaggttttcaccggttgcacctttcttgccagcagcttctttgtagtagccgctgaactgacgctcgagaacgccgtagatacgacggaccttctgcttttcacgcagttgggtgccgtagtcggactggcgaccgcggcgttggccgtggataccaggtgctgcttcaatgttgcacttcgattcgatcgcgcgcacgccgctcttcaggaagagatcggtgccttcgcgacgagcgagtttgcattttggaccaatgtaacgagccattctttacaatctcctggattacacgcggcgcttcttcggcggacggcacccgttgtgcgggattggcgtcacgtcggtgatgctggcgatcttatagccacagccgttcaatgcacggacagcggactcacgacctggacctggacctttgacgttaacgtcgaggtttttcaggccatattccagcgcagcttgaccagcacgttcagcagctacttgagcagcaaacggagtggacttgcgggaaccgcggaaacccgaaccaccggaggtagcccaagaaagcgcgttaccttgacggtcggtgatggtcacgatggtgttgttaaaagaagcatggatgtgggcgatgccatcaaccactgtctttttaacttttttacgaggacgagcagcaggttttgccatgattaatttcctgtcgattcgcgtgggcgattacttgcggatcggcttacgcggacctttacgggtacgcgcgttagtcttggtacgctgaccgcgtactggaagaccacgacgatgacgcagaccacggtagcaaccgaggtccatcaaacgcttgattttcatgttgatttcgcgacgcaggtcaccttcagtggtgaacttcgccacttcgccacgcaattgctcaatctgctcgtcgctcagatctttgatctttgcggctgggtttaccccagtctctgcgcaaattttctgcgcagtagtgcgaccaacaccatagatgtaggtcagcgagataacagtgtgcttgttatctggaatgttaacgcctgcaatacgggccattcagtgggactccaattgacagctacctacgccccggaagccaagaaatagggcgcgagataatatcgctgtaataacaaataatcaacccggcagcgcactagctgccgggcttcaagcggatcacactcagccttggcgctgtttgtgacgcggttccgcgctgcaaattactcgaacaacaccttcgcggcgaataatcttgcagttacggcacagctttttcaccgatgcacgaactttcatcaccaactcctcgaaccttatgggtactcagcgcaacatgccgctgccgtaacccttcaggttggctttcttcatcagggattcgtactggtgcgaaacgaggtgcgattgtacttgggacatgaagtccatcacaaccacgaccacgatcagcaacgaggtcccgccaaggtagaacggaacgtttgctgcaaccaccaggaactggggcaacaggcatacggccgtcatgtatagagcaccgaacatggtcaagcgggtcagaacgccatcaatgtagcgcgcagactgctcacctggacggatgcccggaataaaggcaccggacttcttcaggttttccgctacgtctttcggattgaacatcaacgccgtatagaagaagcagaagaaaataatccctgcactaaacagcagaatattcaacggctgaccaggagcgatcgactgcgagatgtcctgcaaccagcccataccttcagactgaccgaaccaggcacccagcgaagccgggaacagcaaaatgctgctcgcgaaaatagccggaataacaccagccatgttcactttcagcggcaagtggcttgtctgcgcagcaaaaaccttgcggccctgctgacgcttggcgtagtgaacagcgatacgacgctgaccacgctcaatgaacaccacaaaaccgataatcgctactgccagcaaaccgatggcaaccaaggcgaagatgttgatatcaccctgacgcgcagactcgaaagactgcccgattgctctcggaagaccggcgacgatacccgaaaaaatcaacatcgagataccgttacctacaccacgctcagtaatctgctcacccagccacatcatgaacatcgcaccagccacaaaagtggataccgcgacgaaatggaagccaaagtcaccagtgaacgcaacgccctgccccgccaggccaatggacatgccaatagcctgaacgagagcgaggacgacggtgccgtagcgggtgtactggctgatcttgcgacggccagcttcaccttccttcttcaactgctccagctgcgggctgacggcggtcatcagttgcatgatgatcgatgccgaaatgtacggcatgatccccaacgcaaagatgctcatccgttccagcgcaccgccggagaacatgttgaacaagctaagaatggtcccctcattctgtcgaaacaggtctgcgagtcggtccgggttgatacctggaaccgggatgtgtgcgcctattcggtagacgataatcgccaggaacagaaaacgcagacgagcccagagttcagacataccgcctttgccgagcgcagagagagcaccttgcttagccatttattcctcgaacttgccgccagctgcttcgatagccgcacgcgcacctttggtggcgccgattcccttgccgatagtgacagcgcgagccacttcaccggacagcatgatttttacacgctgtacgttgacgttgatcacgttggcatctttcagggactgcacggtgacgatgtcgccttccactttagccagctcggacagacgcacttctgcgcggtccatggctttcagggaaacgaaaccgaacttcggcaggcgacgatgcagcggctgttgaccgccttcaaagcctggagcgatggtgccaccggagcgggaggtctgacctttgtgaccacggccaccagtcttacccaaaccgctaccgataccacggcccggacgatgcttttcgcgacgggaacccggcgctggactcagatcattgagtttcatcgattaaccctcgacacgcagcatgtagtaagccttattgatcatcccgcgattctcgggagtatcctggacttctacagtgtgaccgatgcgacgcagacccagacccttaacgcacaatttgtggttagggatgcggccggtcatgcttttgatcagcgttactttaacggtagccatgatcagaagatctccttgacagtcagaccacgcttggcagcgatggactcaggagattgcatagccttcagacccttgaaagtggcgtgaaccacgtttaccgggttagtcgagccgtagcacttggccagaacgttctgaacgccagcaacttcgaggacagcacgcatagcgccgccagcgatgataccggtaccttcagaggcaggctgcatgtacaccttcgaagcgccgtgaccggacttcattgcgtactgcagggtggtgccgttcaggtcaacttgaatcatgttacggcgagcagcttccattgccttctggatcgcagcaggcacttcacgtgacttgccacggccgaagccaacacgccctttaccatcaccaaccacggtcaacgcggtgaaagtgaagatacggccgcctttaacggttttggctacgcggttaacttgaaccagcttctcaatgtagccttcgtcgcgcttttggtcgttatttgacataacttagaactccagcccagcttcacgagcagcatcagccagcgctttaacgcggccgtggtacttgaagccagagcggtcgaaagccacttgcgagacgccagcggccttagcacgcgtagcgaccagctggccaacctttgtggccgcgtcgatgttgccagtggcgccatcacgcagttctttatccaaagtcgaggcacttgccaggactttgttgccgtcggccgagatgacctgggcgtagatgtgctgcgacgagcggaacacgcagagacgcacgacttcgagttcgtgcattttcaggcgtgctttgcgagcgcgacgcagtcgagtaacttttttgtcggtcatttgctatgccctacttcttcttggcttctttacgacggacgacttcgtccgcgtagcgcacacctttgcctttgtacggctctggtggacggaagtcgcggatctcagcggccacttgacctaccagctgcttgtcgatgcccttgatcaggatatcggtctggctaggggtctcagcggtgatgccttccggcagttcgtaatccactgggtgcgagaagccaagggcaaggttcagaaccgtgccttttgcttgcgctttgtaaccaacaccgaccagctggagcttgcgctcgaagccttggcttacgccttggaccatgttgtttaccaacgcacgcgtggtaccggccattgcgcgagtttgttgatcgccattgcgagcagcgaaacgcagctcaccagcttcttcaacaatctcaacggacgaatggatgttcagttcaagagtgcccttggcacccttcaccgaaagctgttggcctgcgaattttacttcgacaccggctggcagcttaacggggttcttagcgacgcgagacatgcttatccccccttagaacacagtgcaaagaacttcgccgccgacaccggcagcgcgcgcagcacgatccgtcatcacacctttgttggtggagacgatagacacgccaagaccgccacgaactttcggcagatcttcaacggacttgtactgacgcaggcctggacgactaacgcgcttcacttcttcgataaccggacggccttcgaagtacttcagcgagatggacagcgacggcttagcgtcggtggtgatctgaaaatccgcgatgtaaccttcgtccttcaggacttttgctacagcagccttcaacgtggaagacggcatgcttacgacagacttttcagccatctgggcattacggattcgagttagcatgtccgctaacgggtcctgcatactcatgggctagacgctcctaatacagaaaaattagccttgcggctactacttgtcgccgagaacttccgggcatgaaaaacacgggctcaggcgagccggtcattctagacacaccccagaaatgaatcaagccccaaaaggggcttgattcagattcaaggccaccgatggtcaggttcttgcgaacccgaacatcgagactttgacagcaattaccagctggctttaaccagacctggtacgtcaccacgcattgcagcttcacgcagcttgttacggccaaggccgaacttgcggtaaacgccgtgcggacgaccagtcaggcggcaacggttacgcatgcgcgaagcacttgcgtcacgtggttgcttctgcagagctacggtagcttcccaacgcgcttctggacttgcgttcagatcgacgatgatagctttcagcgctgcacgcttggtggcgtacttggcaacggtgagctgacgtttcagctcacggtttttcatgctcttcttggccattttcctactccaatcagttgcggaacgggaatttgaaagcacgcagcagagcgcggccttcatcatcgttcttagcagtggtggtcagggtaatgtccagaccgcggagagcatcgatcttgtcgtagtcgatttccgggaaaatgatctgctctttcacgcccatgctgtagttaccacgaccatcgaaggacttggcattcaggccgcggaagtcgcgaacccgaggcagggagatcgacagcagacgatccaggaactcatacatacgctcacggcgcagagtcaccttgacgccgatcggccatccttcacggactttgaagccagcgatggatttacgagcgtaggtcacaacgactttttggccggtgatcttttccaggtcagcaacagcatgctcgatgacttttttgtcaccgacagcttcgcccagacccatgttcagggtgatttttgtaacgcgtggaacttccatcacgttcgaaagcttaagttcttccttaagtttcggtgcgatttccttccagtaaatctcttttagtcgtgccatggtcttctacctagcagtgttcaagcatcaaccgctttttgggtcgacttgaagacacgaattttcttgccgtcttctactttgaaaccaacgcggtcagccttgttggtttcgccgttgaaaatggcgacgttagaagcgtccagtggagcttctttttcgacgataccgccttgtacgcccgacatcgggttaggcttggtatgacgcttaaccaggttcagaccgccaataaccagacggttatttgcgagaaccttaagcaccttaccgcgcttacctttgtctttgccggcgatcacgatgatctcgtcgtcacgacgaatcttttgcatgtcggatctccttacagcacttctggggcgagcgagacgatcttcatgaacttctcagtacgaagttcacgggtcactggcccaaagatacgggtgccgatcggctcttgcttgttgttcagaagaacagcagcgttgccatcaaagcggataatggagccatcagcacgacgtacgccgtgacgagtgcggactacaacagcagtcatcacttggccttttttcactttaccgcgaggaattgcttccttcacggtaactttgatgatgtcaccgataccagcgtaacgacgatgggagccacccagcaccttgatgcacataacacggcgagcgccgctgttatcggccacatcgagcatggattgagtctgaatcatataatttctccgacccctagtccttagacttccacagcgcgttcgagaacatcaaccagcgcccaagacttggtcttggccaaaggacgagtttcacgaatagtgactttgtcgccgatgtggcactgattggtttcgtcgtgcgcgtgcagcttagtcgaacgcttaacgtatttaccgtagatcgggtgctttacgcgacgctcgatcagtacggtgatggttttgtccatcttgtcgctgacaacacggccagtcagcgtacggacagttttttcggcttcagccatgatcacttacctgcctgctggttgagcacagtcttcacgcgagcgatgtcacgcttaacttgcgagagcagatgagactgccccaactggccagttgctttctgcatacgcagattgaactggtcgcgcagcaagccgagcagttgctcgttcagctgctgtgcggatttttcacgaagttcattcgctttcatcacatcaccgtccgtttaacaaaggcggtggcgagcggcagctttgcagcagccagggcaaaagcctcacgcgccagctcttcagaaacaccctcgatttcatacaggactttacctggctgaatctgggcaacccagtactccacactacccttacctttacccatccgaacttcgagtggcttcttggaaataggcttgtccgggaatacacggatccagatcttgccgccacgtttaacgtgacgggtcagagcacgacgcgctgactcgatctgacgagcggtgagacgaccacgagctacagacttcagcgcgaactcgccgaagctgactttgctaccgcgctgagccagaccacggttgtggcctgtcatctgcttgcggaacttcgtacgcttaggttgcaacatttggcgtaccccttacttagcagcttttttacgaggcgctggtgcttgtggtttcagctcttcttggcgaccaccaattacttcgcctttgaagatccaaacctttacaccgatcacaccgtaagtggtgtgagcttcgtagttggcatagtcgatgtcggcacgcagggtgtgcaatggcacacgaccttcgcgataccattcagtacgtgcgatttcagcaccgccgagacgaccgctcacttggattttgatgcctttggcaccaatgcgcatggcgttctgaacggcgcgcttcatagcgcgacggaacattacacgacgctccagctgctgagctacgctctgcgcaaccagcataccgtcgagttccggcttgcggatctcttcgatattgatgtgcacaggcacacccatttgcttggtcaggtcctgacgcagtttctcaacatcttcacctttcttcccgataacgatacctggacgagcggtgtggatggtgatacgtgcagtttgggccggacgatggatatcgatacggcttacggacgcgctttttagtttgtcttggagatactcacgcactttcagatctgcgaacaagtagtccgcataagtccgaccgtctgcgtaccagacggaggtgtgctccttgacgattcccaggcgaatgccaatgggatgtactttctgacccatctcttcgactccgttacttgtcagcaaccttgacagtgatatggcaagaccgcttgacgatgcgatcagcacggcctttggcacgtggcatgatgcgcttcagcgaacgcccttcgttgacgaaaacggtgctgaccttaaggtcatcaacgtctgcgccttcgttatgctcggcgttggctacggccgactccagcactttcttcatgatctcggcggctttcttactgctgaaagccaacaagttgagcgcttcgcccaccttcttcccgcggatctggtcggcgaccaagcgggctttctgggcggagattcgagcgcccgacaacttagcggctacttccatttccttaccccttaacgcttggctttcttgtcagccacgtgcccgcgatagttgcgggtaccggcgaactcgcccagtttgtggccgaccatgtcttcgttaacgagaaccgggacgtgctgacgaccgttgtgtactgcgatggtcagaccgaccatttgtggcaggatcatcgaacgacgcgaccaagtcttaattggtttgcgatcgttcttttccgccgccacttcgatcttcttcagtaggtgaagatcaataaaaggaccttttttcagagaacgtggcactgtcgtatccctctatttacttgcgacgacggacgatcattttgtcggtacgcttattaccacgagtcttcgcgcccttagtcgggaagccccatggcgataccggatgacgaccaccagaggtacgaccttcaccaccaccatgtgggtggtcaaccgggttcatggcaacaccacgaacggttgggcgaacgccacgccagcgcttggcaccagctttacccagcgaacgcaggctgtgctcggagttcgagacttcgcccagggtcgcacggcattcagccaggactttacgcatttcaccggaacgcagacgcagggtaacgtacacgccttcacgagcgatcaactgagccgaagcaccagcggaacgagcgatctgtgcgcctttacctggcttcagttcgatgccgtgtacggtagaaccgactggaatgttgcgcagttgcagagcgttgcctggcttgattggagccagagcgcctgcgatcagctggtcgccagcactcacgcctttaggggcgatgatgtagcggcgctcgccgtctgcgtagcagagcagtgcgatgtgagcagtacggtttggatcgtattcgatacgctcgacagtggcgacgatgccatctttgtcgttgcgacggaaatcgaccatacgataatgctgcttatgaccaccaccgatgtgacgcgtggtaatacggccattgttgttacgaccaccagtcttcgattttttctcgagcagcggtgcgtgaggagcgcctttatgcagctcctggttgaccaccttgaccacaaaacggcggccaggggaagtcggtttgcatttaacgattgccatgatgcaccccttccttactcagcactgctgctgaaatcgagatcttggcctggctgaagggagataactgccttcttccagtcattacgcttgcccagaccgcgagcagtgcgcttgctcttacccagaacgttcagggtagtgacgcgctctactttcacgctgaacaggctttcgacggccttcttgatttccagcttggttgcatcagtagcaaccttgaaaacgaactggcctttcttgtctgccagaaccgtagccttctcggaaacgtgcgggccaagcagaactttaaatacgcgttcctggttcatcccagcagctcctcgaatttcttcacggccgacacggtgatcaacaccttgtcgtatgcgatcagactaactggatcggaaccttgaacgtcacgtacatcaacgtgcggcaggttacgagcagccaggtacaggttctgatcaacagcgtccgacacgatcaaaacgtcggtcaggctcatgttgttcagcttgcccagcagatctttggttttcggagtttcaacagcgaaatcctgaaccacgaccagacgatcagtacgcaccagctcagcaagaatggaacgcatcgctgcgcgatacatcttcttgttcagcttctgggagtgatcctgtggacgtgctgcaaaagtggtaccgccgccacgccagattgggctacggatagtaccggcacgagcacggccagtacctttctgacgccatgggcgcttaccgccaccacgaacgtcggaacgggtcttttgctgcttggtaccttgacggccgccggccatgtaggccacgactgcttggtgaaccagcgtctcgttgaattcgccgccaaatgtcagttcggaaacttcgatcgcttgagcgtcatttacatttaattgcatgtcagcttccccttaaccgcgagccttggctgctggacgtacaaccaggttgccgccagtagcgccaggaacagcacccttgaccaacaacagattgcgttcagcgtccacgcgcactacttccagggactgcacggtcacgcgctcagcgcccatatgaccggacatttttttgcccttgaatacacgaccaggagtctggcactggccgatagagcctgggacgcggtgggatacggagttaccgtgggtgttatcttgcccgcggaaattccaacgcttgatcgtaccctgaaagcccttacccttggactgaccggttacatcaaccagttgaccagcggcgaagatttcagcgttgatcagatcgccagcctggtactcgccttcttcaagacggaattccatggtggtgcgaccagcggcaacgttcgctttagcgaagtggccagcctgagctgctgttacacgcgaagcacgacgctcgccgacagtgacttgcactgcacgatagccatcggtctcttcagttttgaactgggtgacgcgattcggttcgatctcaatgaccgtgaccggaatggagacaccttcttcggtgaaaatacgggtcataccgcatttacgaccgactacaccaatagtcatgttgtaaacctcatgagtgtacggggctttcacccgctatggccgcccatttcagagcgttacacgactaagaccgagtcttagccgaggctgatctgcacttccacaccggccgcaagatcaagcttcataagagcatcaacggttttatccgttggctggacgatgtccagaacgcgcttatgagtgcggatttcgtactggtcgcgcgcgtctttgttgacgtgcggagaaaccagaacggtgaaccgctctttacgggtaggcagtggaattggaccacgcacttgagcaccagtacgtttcgcggtttccacgatttcctgggttgattggtcgatcaggcgatggtcaaaagccttcaacctgatacggatttgctgattttgcattggatttcagactccggctgctattcccaccgagcgcaatacgcccgttaaaaggaggcgcaattctatagacgccccagataggtgtcaacccaataaaaaagcccccgctgagcgggggctttctcaagtcaacaagcaaactctataaaagagattactcgatgattttggctacgacgccagcgccgacggtacgaccgccttcacggatagcgaaacgcagaccatcttccatcgcgatggttttgatcagggtaacagtcatctgaatgttgtcacctggcattaccatttcaacgccttctggcagctcgcagttaccagtcacgtcagtagtacggaagtagaactgtggacggtagcctttgaagaacggagtatgacgaccgccttcttccttgctcagaacgtaaacttctgcggtgaacttggtgtgcggcttaacggtacccggcttaaccagaacctgaccacgctcaacgtcgtcacgcttggtgccacgcagcagtacgccgcagttctcgccagcacgaccttcgtcgagcagcttgcggaacatttcaacaccggtgcaagtagtcacggtggtgtcacgcagaccaacgatttccagaggatcctgaacacgaacgataccgcgctcgatacgaccagtcacaacagtaccgcgaccagagatcgagaatacgtcttcgattggcatcaggaacggcttgtcggtcagacgtactggttctgggatgtagctgtccagagtttcaaccagcttcttgacggcagtggtacccatctcgttgtcgtctttgccttccagagccatacgagccgaaccgatgatgattggagtgtcatcgcccgggaagtcgtaggtggacagcaggtcgcgaacttccatctcaaccagttccagcagctcagcgtcgtctaccaggtcagccttgttcaggaaaaccacgatgtacggtacgccaacctgacgggacagcaggatgtgctcacgggtttgtggcatcggaccatcagcggccgagcaaaccagaatagcgccgtccatttgagcagcaccggtgatcatgttcttcacatagtcagcgtgacctgggcagtcaacgtgagcgtagtgacggatcttcgagttgtactcaacgtgtgcggtgttgatggtgataccgcgagctttctcttccggtgcgctgtcgatcttgtcgaagtcaacgattgccgaaccgaaaacttcggagcaaacgcgagtcagagcagcagtcagagtggttttaccgtggtcaacgtgaccgatggtgccaacgttgacgtgcggtagggaacgatcaaatttttctttagccacgacaattaactcctagcctaaaggggctgaatcagccttgttttttggttacggattcgacgatgtgcgacggagccgtatcgtattttttgaattccatagagtagcttgcgcgaccctgagacatggaacgaacgtcggtcgcataaccgaacatctcacccagtggaacctcggcacggataaccttgccggacactgtgtcttccataccctggatcatgccgcgacgacggttaaggtcgcccatcacatcacccatatagtcttcaggcgtaacaacctctaccgccatgatcggctcgagcaactcaccaccgcccttctgggccagttgcttggtcgccatggatgcagccactttaaacgccatctcgttggagtcgacgtcgtggtaagaaccatcgaacacggtagccttcaggccgatcagcggatagccggcaactacgccgttcttcatctgctcttcgatacccttctggatagccgggatgtattccttaggaaccacaccacctactacttcgttcacgaattgcagaccttcctgaccttcgtcagcaggagcaaaacggatccagcagtgaccgaactgaccacgaccgccggactgacgaacgaacttgccttcgatttcacagttcttcgtgatgcgctcacgatacgaaacctgaggcttgccgatgttggcttcgacgttgaactcacggcgcatccggtcaaccaggatgtccaggtgcagctcgcccatgccggagatgatcgtttgaccagtctcttcatcagttttaacgcggaaagacgggtcttcctgggccagcttgcccagtgcgatacccattttttcctggtcatccttggtcttaggctctacggcaaccgaaataaccggctccgggaagtccatgcgaaccagaatgattggcttgtcagcgttgcagagggtttcaccagtggtgacgtccttcatgccgatcagggccgcgatgtcgccagcgcgtacttccttgatctcttcacgggcgtttgcgtgcatttgcaccatacgacccacgcgctctttcttgcctttaaccgagttgatcacgccgtcgccggaggccaacacgcccgagtaaacgcggacgaaagtcaaagtacccacgaatgggtcggtagcgatcttgaacgccagagccgagaacggctcattgtcgtctgcatgacgctccatctcttcttcctcgttatcagggttggtacccttgatagcaggaatgtcggttggagcaggcaggtagtcgataacggcgtcgagaaccaagggaacacccttgttcttgaaggaggaaccgcaaacagccaagacgatctcaccagcaatagtacgctgacgcagagcagccttgatttccacgttggtgagttcttcaccttcgaggtacttgttcatcagctcttcactggcttcggcagcagcctcaaccatgttgttacgccactcgtcagccagctcctgcagttctgcagggataggcttgcgaacaggcaccatacctttgtcagcatcgttccagtacacagcttccatgttgatcagatcgatctgaccctggaagttgtcttcggaaccgatagccaactggatcggcaccggagtgtgacccagacgttgcttgatctggccgatcacgcgcaggaagttggcaccagcacggtccatcttgtttacataaacaagacgtggaacgccgtatttgttggcttgacgccatacggtttccgactgaggctcaacacccgaagtaccgcagaacacaacgacagcgccgtcgagtacgcgcagggaacgctcaacttcaatagtgaagtcaacgtggcccggggtatcgattacgttaaagcgatgctcgtccttgtactgcttctcggaacctttccagaaggcggtgatagcagcagaagtaatggtaataccacgctcctgctcctgcaccatccagtctgtggtcgcggcgccatcatgcacctcgcccattttgtgacttttgccggtgtaaaaaaggacgcgctcggtggtggtggttttgccagcatccacgtgagcgacgataccgatgttacggtagcggctaatcggagtagtacgagccataaagccctcgcaaaattagtgaagctaaaattagaagcggtagtgcgagaaagctttgttagcttcagccatacggtgcacgtcttcacgcttcttaacagcagcacctttaccttcagcagcatccagcagttcgccagccaaacgcagagccatagacttctcgccacgcttacgtgcgaagtctaccaaccagcgcattgccagagcgttacgacgggaaggacgaacctcgaccggaacctggtaagtagcaccaccaacgcggcgcgacttcacttcgaccagcggagcgatggcgtcgagtgctttttcgaagagttccaggggatcggtgccagccttacgggtcgcaacggtttccagggcaccataaacgatacgctcggcaacggctttcttgccgctttccataacgtggttcatgaatttggcgaggatctggcttccgtatttcggatcgtccagaatctcacgctttgctgctacgcgacgtcttggcatgataagccctcaagcggtcttcaggttagctcgggacagatccaatggatgcgtgcccgaccttactcttatcgactcaataaaatgaaaatctgcaaaacggccgattacttcggacgcttggtaccgtacttcgaacgaccctggttacgacctttaacgccggaagtatccaaggagccgcgaacggtgtggtaacgaacacctggcaagtcttttacacgaccgccacgaatcagtaccacgctgtgctcttgcaggttgtgaccttcaccaccgatgtacgaggaaacctcgaaaccgttggtcaggcgcacacggcatactttacgcagtgccgagttaggttttttcggcgtagtggtgtacacacgggtgcacacgccacgacgttgcgggcagttctgcagcgcaggcacgtcggatttctcgacgatacgcttacgcggctgacgtaccagctggttgatagttgccatctactagctccactgttgtcttgcgacgctattgtcttgcaagaaaagcaaaatggcaggaacgaattcccgccaaatttaggggatcaagagtctaaagaggatcttgtccccagtcaaggcaaggccccgacctccccgccccccgaacctcgacaaattgtctcgattcgatgaacggagcgatcagggccttacgctcatttatcgcagaactcagttaccgctcgagttcagcgcttcggtcagtgcagcttccacttcactggcgcttacgcgcaacggcttgtctgcttcacgacgacgcttgcgctcgctgtgatatgccaggccggtacctgccgggatcagacgacccacgacaacgttttctttcaggccgcgcaggtaatcgcgcttgccggtgactgccgcttcggtcagtacgcgggtggtttcctggaaggaagccgccgagatgaacgattcggtggacaacgacgccttggtgatacccagcagaacgcgagtgtacttggagacgaacttgtcttcgccgcccagacgctcgttctctaccagtacgtgagtcagttccatctggtcgcccttgatgaaactggaatcgccggattcagcgatttcaactttacgcaacatctgacgcaggatggtctcgatgtgcttgtcgttgatcttcacgccttgcagacggtaaacgtcctggatctcgttaacgatgtacttggccagcgcgctcacacccagcagacgcaggatgtcgtgcggatcgcttgggccgtcggagataacttcgccgcggttgacctgctcaccttcgaacacgttcaggtgacgccacttcggaatcagctcttcatacggatcgctaccatcgttcggggtaataaccagacggcgcttgcctttggtttctttaccgaacgcgatggtgccgctgacttcagccagaatcgacgcttctttcggacgacgagcttcgaacaagtcggcaacacgcggcagaccaccggtgatgtcgcgggtcttcgaagtttcctgcgggatacgcgcgataacatcaccgatcgcgatcttcgcaccgtcagcaacaccgaccagggcgttggctggcaggaagtactgagcgataacgtcagtgcctggcagcaacagatccttgccgttgtcatcgaccatcttcacggctggacggatttctttgcccgcagctggacgatctttcgcgtcgagtacttcaatgttggtcataccggtcaattcgtcagtctgacgcttgatcgtgatgccttcttccatgcccacgtaggtcacggtacctttcatttcggtaacgatcgggtgagtgtgcggatcccacttggccacgattgcgccagcgtcgaccttgtcaccctctttaaccgaaatcacagcaccgtacggcagcttgtaacgctcgcgctcacgaccgaagtcatcagcgatggccagctcaccggaacgggacacagccaccaggtgaccatccactcgctccacgtgcttcaaattgtgcagacgaacggtaccgccatttttcacctgaacgctgtccgcagcggaagtacggcttgccgcaccaccgatgtggaacgtacgcatcgtcagctgggtacccggctcaccgatggactgggcagcgataacgccgaccgcttcaccgatgttcacctggtgaccacgagccaagtcacggccgtagcacttggcgcaaatgccatagcgggtttcgcagctgatcggcgaacgcacgatcacttcgtcgatgctgttcagctcgatgaactcgacccacttctcgtctaccagagtgccggcaggaacgataacgtcctcggtacctggcttgaatacgtcacgggcaataacacgacccaatacgcgttcacccaacggctctacaacgtcaccgccttcaatgtgcggagtcatcagcagaccgtgttcggtgccgcaatcgatctcggttacaaccagatcctgcgccacgtctaccagacgacgagtcaggtaaccggagttcgcagttttcaacgcggtatccgccagacctttacgagcaccgtgagtggagatgaagtactgaagtacgctcaaaccttcacggaagttcgcagtaatcggcgtttcaatgatggaaccgtccggcttggccatcagaccacgcataccggccagctgacgaatctgtgctgcggaaccccgcgcacccgagtcagccatcatgtacatcgagttgaaagactcttgatcgacttcaacgccgtgacggtcgataaccttctctttcgagaggttggccatcattgccttggaaacttcgtcgttcgctttcgaccaaaggtcgatcactttgttgtacttctcgccctgggttaccaggccggaggcgtactggctctcgatctctttcacttcgtcggtggcagcaccgatgatgcgggctttctcgtccgggataacgaagtcgttaacaccgatggaaacgccggagatggtcgagtaagcgaaaccggtgtacatcaactggtcagcgaagatcacggtctctttcaaaccaaccacgcggtagcactggttgatcagcttggagatcgcctttttcttcatcggcaggttgacgacgtcgtacgacagaccttttggcacaacctggaacagcagcgcacggccgacagtggtgtcgacgatacgggtaccgctcacgctgttgccgtcacggtcgttgacggtttcgttgatacgaaccttaaccttggcgtgcagtgcggcttcgccggcacggaacacacggtcaacttcctgcagatccgcgaacacacgaccttcgcctttggcgttgatcgcttcacgagtcatgtagtacagacccaatacaacgtcctgcgacggaacgatgattggctcaccgttggctggcgacagaatgttgttggtcgacatcatcaacgcgcgcgcttccaactgggcttccagtgtcagcggtacgtgcacggccatttggtcgccgtcgaagtcggcgttgtacgcggcgcagaccagcgggtgcagctggatagccttaccttcgatcagtaccggttcaaacgcctggatacccagacggtgaagggtcggtgcacggttgagaagaaccgggtgttcgcgaatcacttcagcgagaacgtcccaaacctctggcagttcgcgctcgaccattttcttggccgctttgatggtggtcgcgagaccacgcatttccagcttgccgaaaatgaacggtttgaacagctcgagagccatcttcttcggcagaccgcactggtgcagacgcagggtcgggcctacggtaattaccgaacgaccggagtagtcaacacgcttaccgagcaagttctgacggaaacggccttgcttacccttgatcatgtcggccagggatttcagaggacgcttgttcgaaccggtgatagcgcggccacgacgaccgttgtcgagcagagcatcgacagcttcctgcaacatacgcttttcgttgcgcacgatgatgtccggagcggacagatccagcaggcgcttcaaacggttgttacggttgatcactcgacgatacagatcgttgaggtcggaagtcgcgaaacgaccgccgtccagcgggaccagtggacgcagatctggcggcagaaccggcagaacggtcagcaccatccactctggcaggttgccggaaccctggaaggcttccatcaacttcagacgcttggacagcttcttgatcttggtttccgagttggtttgcggaatttcttcgcgcagacggccaatctcgtgttccaggtcgatagcgtgcagcagttcacggacagcttcagcacccatgcgggcgtcgaagtcgtcaccgaactcttccagcgcttcgaagtactgctcgtcgttcagcagctgacctttttcaagggtggtcatgcctggatcgataacgacatagctctcgaagtagagaacgcgttcgatatcacgcagggtcatgtccatcagcaagccgatacgggacggcagcgatttcaggaaccagatgtgggcaactggcgaagccagttcgatgtgcgccatgcgctcacgacgaaccttggccagtgcaacttcaacgccgcacttctcgcagatcacaccacggtgcttcaagcgcttgtacttaccgcacaggcactcgtaatcctttaccgggccaaagatcttggcgcagaacaggccgtcacgctcaggtttgaacgtacggtagttgatggtttccggctttttaacttcaccgaacgaccatgagcggatcatctcaggcgaggccaatccgatacggatggcgtcgaactcttcgacttgaccctggtttttcagcaaattcagtaggtctttcaaggcctttcctcctggcggagcagagagcgggcaatcctgccccgctctcgattcgcgtcacgtgttattcggtttccagatcgatatcgatgccgagggaacgaatttccttgatcaacacgttgaaggactcgggcatgcccggctccatacggtgatcgccatccacgatgtttttgtacatcttggtacggccgttcacatcgtccgacttcactgtgagcatttcttgcagagtgtaagcagcaccgtatgcttccagtgcccagacctccatctccccgaaacgctgaccaccgaactgcgccttaccacccagcggctgctgggtaaccaggctgtacgaaccggtagaacgcgcgtgcatcttgtcgtctaccaagtggttcagcttcagcatgtacatgtagccaacggtaactggacgctcgaacttgttgccggtacggccgtcagtcagctgcatctggccgctttccggcaggtctgccagtttcagcatggccttgatttcgctttccttggcgccgtcgaacactggggtggccattggaacaccgccacgcaggttcttcgccagatccaggatttcctgatcggagaagctgtccagatcttcgttgcgaccgccgatctggttgtagatctcgtccaggaaggtgcgcagctcagcaactttacgctgctcttcgaccatccggttgatcttctcgcccagacctttggccgcgaggcccaggtgggtttcaaggatctgaccaacgttcatacgcgaaggtacgcccagtgggttgagaacgacgtcgaccggggtgccattggcatcgtgcggcatgtcttcaaccggcatgatcacggagaccacacctttgttaccgtgacgaccggccatcttgtcgcccggctggatgcgacgacggattgccaggtaaaccttgacgattttcagcacgcctggagccaggtcatcgccctgctgcagtttgcgcttcttgtcttcgaacttgtcgtccagcagacggcgacgatcaacgatataggcctgagccttctcgagctgctcgttcagagcatcttcagccatgcgcagtttgaaccactgaccatgctcaagaccgtcgagaacttcgtcggtgatgtcctgacctttcttcagaccagcgccgccttcagccttgtggcctaccagagcagagcgcagacgttcgaaagtagcgccttcaacgatacggaactcttcgttcagatccttgcggatctcgtccagctgggacttctcgatcgacagtgcacgagcatcacgctcaacgccgtcgcgggtgaagacctgtacgtcgatgacagtacctttggtaccggtaggtacacgcagggaggtgtctttaacgtcgctggctttttcaccgaagattgcgcgcagcagtttttcttccggagtcagttgggtctcgcctttcggagtgaccttaccgaccaggatgtcgcctgcgccgacttcagcacctacgtaaacgataccggcttcgtccagtttgttcagtgcagcttcacccacgttcgggatgtctgcagtgatctcttcaggcccaagcttggtgtcacgcgccacacaggtcagttcctgaatgtggatcgtggtgaaacggtcttcctgaaccacacgctcggacaggcagatggagtcttcgaagttgaagccgttccatgccatgaacgcgatgcgcatgttctgacccagcgccagttcacccatgtcggtggacgggccgtcggccatgatgtcactacgctgaacgcgatcacccttgctcaccagcggacgctggttgatgcaggtgttctggttcgagcgggtgtatttggtcaggttgtagatgtcgacaccagcttcgccggtttcaacttcgtcatcagcaacacgaaccacgatacggctggcgtcgacggagtcgatcacgccgccacgacgagccacgacgcaaacgccggagtcacgggctacgttacgctccatgccggtacctaccagcggcttgtcagcacgcagggtcggtacagcttgacgctgcatgttcgaacccatcaacgcacggttggcgtcgtcgtgctcgaggaacggaatcagcgacgccgcaaccgaaactacctgcttcggcgaaacgtccatcagggtgacttcttcaggcgccttgacggtgaattcgttcaggtgacgtacggctaccagttcgtcgatcaggactttctggtcattcatggtcgccgaagcctgcgcgatcacgtgatcggcttcttcaatggcggacaggaacacgatctcgtcggtgaccacaccctctttcaccacgcggtacgggctttccaggaagccgtactggttggtgcgagcgtacgcagccagggagttgatcaggccgatgttcggaccttccggcgtttcaatcgggcatacgcgaccgtagtgagtcgggtgtacgtcacgaacttcaaagcctgcgcgctcacgagtcaacccgccagggccgagtgcagaaacacgacgcttgtgggtgatctcggacagcgggttgttctggtccatgaactgcgagagctgactggaaccgaagaactctttcaccgccgcagccactggcttggcgttgatcaggtcttgcggcatcaggccttcgctttcagccatcgacagacgctctttgaccgcacgctcaacacgtaccaggccaacgcggaactggttctcggccatttcgcctacgcagcgaacacgacggttacccaagtggtcgatgtcatcgacgatgcctttaccgttacggatgtcgaccagagtcttcagtaccgcgacgatgtcttccttgcacagcacgcccgaaccttcgatctcggtacgaccgatacgacggttgaacttcatccggccgaccgcagacaggtcatagcgctcagggctgaagaacaggttgttgaacagggtttcggcagcgtccttggttggcggctcgcctggacgcatcatgcgatagatctcgaccagcgcttccaattggttgctggtggagtcgatcttcagcgtgtcggaaacgaacggaccgcagtcgatgtcgttggtgtacagagtttcgatgcgaacaacgccggacttggcaatttttgccaggacctcggtgttcagctcggtgttgcactctgccaggatttcgccggtagccgggtgcacgatgaccttggcggtagtacggcccaggacgtagtccagaggtacttccagagtcttgataccggctttttcgatctggttgatgtggcgcgcggtaatacggcggcccgcttcaacaatgaccttgcccttctcgtcctgaatgtccagaaccgcaatttcaccacgcagacgcgaagcaatcagttccaggctgagggtttcgccgctcaggtggaaaacgttggtggtgtagaaagcgtccagcacttcttcagtggtgtagccgagcgcgcgcagcagtaccgatgccggcagcttgcgacgacggtcgatacgcacgaacacgcagtctttcgggtcgaactcgaagtccagccacgaaccgcggtaaggaatgatgcgcgcggagtacagcagtttgccggagctatgcgtcttgccgcggtcgtggtcaaagaacacgcccggggaacggtgcagctgggaaacgattacacgctcggtaccgttgattacgaaggtaccgttctcagtcatcagggggatttcacccatgtagacttcttgctctttgatgtccttgatcgctttgttcgacgattctttgtcgaaaatgatcaggcgcacttttacccgcaaaggtacggcgaaagttacaccgcgcaatacgcattctttgacatcaaatgccggttcgcccaagcgataaccgacgtactccagcgcagcattgccggagtagctgatgatcgggaaaacggatttgaaggccgcatgcaggcccacgtcgcggaactgatctttagtcgctcccgcttgcaagaattcacgatacgaatccagctggatggccaggaggtaaggcacatccatgacgtccggcaacttgctaaagtccttgcggatacgttttttctcagtatatgagtaagccatcagcgttccccagcttggtcacctgcttgtttggcccctcccgacgggagcagccagaaaatcgtgcaaaccccatggtttgcgccaccgcatcgggtggttacagcgcctttatcagcaccgacccagtcggctgccaataacggaaaaaggccggtggcaagagccaccagccatcagcctgtcgcttgacgctcgggctggaggagcaaagtcgatacttatttcagctcgactttagcgcctgcttcttccagcttcttcttggcgtcttcagcagcttctttcgaaacgccttcagctacaacctgaggagcgccgtctactttctctttggcttctttcaggcccagaccggtcagttcacgaactgccttgatcacgttaaccttcttctcgccggcttccagcagaacaacgttgaactcggtttgctcttcaacaacagcggcagcagcagctggaccagccgaagcagcggcagcggatacgccgaacttctcttccattgccttgatcagctcaacgatttccagaaccgatttttcgccgattgcgtcgatgatttgttcgttagtcagagacatgacttatttcctgaattgggggatagcctggaggccatcgaaataaacaaaaatacgcgagagaggaaacgctcagcctcaggctgcagcagcttctttctggtcgcgaagtgccgccagagtacgagccaatttgctggtagcgccttgaatcacgctcatcagctgggaaattgcttcgtcacgggtcggcaggcttgccagaacgtcgatctgattagctgcgaggaacttgccctcgaacgcagctgccttgatctcgaacttgtcctgacctttagcgaactctttgaacagacgagcagcagcgcccgggtgttcgttggagaatgcgatcaaggtcgggccggtgaacacgtcgttgagaacactgtattcagtgtcagcaacagcgcgcttgagcagggtgttacgtacaacacgtacgtaaacgccagcttcacgagcctctttacggagtccggtcattgcgcctactgttacgccacgtgcatcaaccacgacagcggacagagcgactttggcagcctcgttgacttcagcgacgatggccttcttgtcttcgagattaattgccacgggtttaactcctgcttgttaccgtttcattcgatcggaaccgaatgtcgttttggtgtctgattcggtaaggaaccgggagcaccatctgcgtaggctgatggtttaagacttgcgtcgcctacggtcttggatagcccccgccaggcagggaccccaatctttcaattggcgcgaaaaaaatcgcgccaacctttgtcttacgcgtccagcgagctctggtcgataaccagacctgggcccatagtggtgctcagggtaacgcgcttgacgtaaatacctttcgaggaagctggcttgatacgcttcagatcagcgatcagggcttcaacgttttccttcagcttgacggcgtcgaagcccatcttgccaacggaagtgtgaatgatgccgtttttgtcggtgcgataacgaacctgaccagctttagcgtttttaaccgcggtagctacgtctggagttacggtaccaaccttagggttaggcatcagaccacgtgggccgaggatctgacccagttgacctacaacgcgcatggcatccggggatgcgatcactacgtcatagttcaggtcgccgcctttcatttcggcagccaggtcgtccatacctacgcgatcagcgccggcagccagagcggcttcagcagccggaccctgggtgaatacagcaacgcgaacagtcttgccagtgccgtgcggcagcacagtagcgctacgaacaacctggtcggatttacgcgggtctacacccagatttacagcaacgtcgaacgactcgctgaacttgacagtcgacagctcagccagcagggcagcagcgtctacaatgttgtaggccttgcctgcttcgattttgccggcgatagccttttgacgcttggtcagcttagccattacacaccctccacgttaaggcccatgctacgagcagaaccggcgatagtacgcacggctgcatccatatcagctgcagtcagatccgcgtttttggttttcgcgatttcttccagctgagcacgggtaacagtgccaaccttaacggtgttcggacgagcggaaccgctggtcagaccggccgccttcttcagcagaaccgaagcaggagtggatttggtttcaaaagtgaagctacggtcgctgtagacagtgatgatcactggagtcggcagacctgcttcaagaccctgagtacgggcgttgaaagccttgcagaattccatgatgttcacgccgtgctgacccagagcaggaccaacaggtgggcttgggttagcctgagcggccttcacttgcagcttgatgtaagcggtaattttcttggccatgaggcactccaattacgggttcgaacgcctcgaaaggctccccggttacttgcgcgtttatcccagtgacgacaaaaccccacagcctagggctgcggggttgggatgcttgtccagttagaccttttcgacctgactgaactccaactctaccggggtagagcgaccgaaaatgagcactgccacttggatccggctcttttcgtagttaacttcttcaacgacgccattgaaatcagcaaatggaccatcattgactcgcaccgtttcacctggctcgaagagagtcttcggcttaggcttgtcgctaccatcagcaacacgacgcagaattgcttccgcctctttatcggtgattggcgcaggcttatcagcagtaccgccgataaaacccatcacccgaggagtatccttgaccaagtgccaagtaccctcattcatatccatctgaaccagcacatagcctggaaagaactttcgttcgcttttgcgtttctggccattacgcatttccaccacttcttcagtgggaaccagaatctcgccaaagccatcttccatgccagccagctttacgcgctcgacgagcgagcgcattacatgcttctcgtaacccgagtaagcatgcacaacgtaccaacgcttagccacgggacacccttagccgacaatcaaggaaacaagccagccgagcagggaatcaagaccccacaacagcaacgccataaccagaacaacagccaccacgataagggtggtctgcgtggtttcttggcgagttggccacacgactttacgaatttcggtgcgagcttccttaaccagtacaaagaaagacttgcccttcgccgtttgcaagcctacaaaggcagctacagcagcaatgacaagcaatgcgagtacacggtacaggatcggcgaagcagagtaatactgattgccaacaacgccaacaaccaccaaagcgactactgcaagccacttgagcagatcgaagcgagagccttgagcttcagctttaggagtcatctatgaagatcctgtgaaaagaaagccagacacacgaagtgaatctggcaggtcaggagggaatcgaacccccaacctacggttttggagaccgtcgctctgccaattgagctactgacctaaaacaaaatcaggccgaccattatgccggcccgaaaaagacattacaacaacttactcgatgattttagctacgacgccagcgccgacggtacgaccgccttcacggatagcgaaacgcagaccatcttccatcgcgatggttttgatcagggtaacagtcatctgaatgttgtcacctggcattaccatttcaacgccttctggcagctcgcagttaccagtcacgtcagtagtacggaagtagaactgtggacggtagcctttgaagaacggagtatgacgaccgccttcttccttgctcagaacgtaaacttctgcggtgaacttggtgtgcggcttaacggtacccggcttaaccagaacctgaccacgctcaacgtcgtcacgcttggtgccacgcagcagtacgccgcagttctcgccagcacgaccttcgtcgagcagcttgcggaacatttcaacaccggtgcaagtagtcacggtggtgtcacgcagaccaacgatttccagaggatcctgaacacgaacgataccgcgctcgatacgaccagtcacaacagtaccgcgaccagagatcgagaatacgtcttcgattggcatcaggaacggcttgtcggtcagacgtactggttctgggatgtagctgtccagagtttcaaccagcttcttgacggcagtggtacccatctcgttgtcgtctttgccttccagagccatacgagccgaaccgatgatgattggagtgtcatcgcccgggaagtcgtaggtggacagcaggtcgcgaacttccatctcaaccagttccagcagctcagcgtcgtctaccaggtcagccttgttcaggaaaaccacgatgtacggtacgccaacctgacgggacagcaggatgtgctcacgggtttgtggcatcggaccatcagcggccgagcaaaccagaatagcgccgtccatttgagcagcaccggtgatcatgttcttcacatagtcagcgtgacctgggcagtcaacgtgagcgtagtgacggatcttcgagttgtactcaacgtgtgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagtcaacgtgagcgtagtgacggatcttcgagttgtactcaacgtgtgcggtattgatggtaatgccgcgtgctttttcttccggagcgctgtcgatcttgtcgaagtcaacgattgccgaaccgaaaacctcggagcaaacgcgagtcagagcagcagtcaaagtggttttaccgtggtcaacgtgaccaatggtcccaacgttgacgtgcggcagggaacgatcaaatttttccttagccatcgatatcacccttaacagaagaattgagcaaacaacatcagccattaaaacaaaggcagatattttcatatctgccttgttatatggagctcttgagcggatttgaaccgctgacctcacccttaccaagggtgtgctctaccaactgagctacaagagcgaaacactttgcacaacctgcaaacttggagcgggtagcgggaatcgaacccgcatcatcagcttggaaggctgaggttctaccactaaactatacccgcggagcctgcagctcacgcttaaatctggtggagggagaaggattcgaaccttcgaagtcgtagacgtcagatttacagtctgatccctttggccgctcgggaacccctcctaatcaggccggcattctatatcatgccaagcccctgtcaagcattttctcatttaaaaacctgagcttagctgcattgacaccgcttcactttgaaaccccgtctgggtcttcactgtggagcgggcgccattctatgcaaactattcggcaggtgcaaccccctcacacagcattattttatgttttaactcattgaattccttggaaaggttttgcaattgcacactccccaacaaacgctggctctcaggcgcaacagacagccaataacccgcccccaaagcccccttcgacgaggactgcccattaacccccatttcagccaaacgctgctgaagagctgaaatcgactcctgtcgagtaaagcccccgagaaagaggcactcttggcgccgcgccccctgcacctcccgtacatcaccggtcgtctcactcagtaggcgaatatcctgctgcgaacccctatacaaactaagaggcgtcacatcctttgcccgcaagggcgcctcctgctgatgccagacataatagaaaacattgagaaccagaagcaggaggaacaaccaacgcatacaaacctcaggacaaaggacaagccatagccagccccacaaacaccaggtccggaacgattctggcctcaggaacaacacctgcaaccagatcagcatcaccaccggttataaagacagcgaagtcagccccccaataggagtgcgccatttccaactgcgtcaatacgaagcctcgcaacatcaatgaacacccacgctctaccgcctcaacggtagtccgccccggcgcgttactggacagcgcccgttcagcagccaaatccccataacgaatctttcgggtatgagtacgcaactggtttcgcatcagcggcattccaggacaaataaagccgcccagatgctcgccatcagccgcgataaaatcagcagttaccgccgtaccgaaatccagtaccaggcaagcacttcccgaagacaggtgaaacccacccagcatcgccagccatcgatcaagcccaaggcgctcatagtcttcgtaaccatttctaacgcctgacatttcgcgagcagatttcgcgcacaccaccgaaataccgaattcccgctcaataatttcgatcagagcgccggtttcttcactggtccttacactgaccagtcgacatttacgcagacaaagccggtcaaacgcccgcaaactctcaagcagcgccaaatcagagtcgacgaccccttccgagaccaggccgccgaccgtggcattcagcacgcgccattttataaagctgtttccgcagtcgagctcaagaatcatcacgcaacctcaggctgagctcaccaccactaaatactctttccacgccgttcaccctcaagcgcagagcaccttgattatcaattccgagcaccacaccatctatgtgactggcaccggcaatcaacgataccgatcgctcctgccacaagtgattcgcctcccattccgcccgaaggaccgaaaaaccactcacctgatgacaccgaatgtaggcgtccaactgattactcagctcagccaccaaagcattacgatcgcagctactgccagactcaagtcgaatagatgtccactgctgatcgacctcatcagcaacctgcatattcacattgataccgatacccagcaccacatgacagacatcggcggggtcgccaacgagctcaagcagaatgccggcaattttcttgttacccaccagaacatcattgggccatttcaaaccggcatttaccacgccaaatcttcgcagcgcctgcatcacagccaaccctacaacaagactcaacccttcgagctggcgcattccaccatcgattcgaaggacaaggctgtaatatagattttcagcaaacggactgacccacttacgacctctgcggccgcggccagaaacttgccgctctgcaagcaccaaaaacggcgccagactgccttgaccaatagaacgcaatgcttcggcattagtcgagtcgaccgaatccagaacggtcaccggccaatccggtgccattgtcgatatctttagagagtcgagcagcattaatggcgatgccagttgatagccccgcccccggactttatggatagacaaacccagctcagcctctagatgctgaagctgcttccatactgcacttcgacttattcccagggcctcgcccagatcctgaccagaatggaaacgcccatccttcagaagattcaacaacgtcagcatgcaggtctcgcctcacaatgaggcccgaataatagccatgccccgcgccgttgcatagaaatcaagcaagcgcttttctaacgagcaaaacaaaaccccaactgctttcgcaattggggtttcggaatttaatcttgacgactcctacaggggaatgcattccaaatgtaggagtgagcctgctcgcgatgaggccagtcaggccaatgaaaattctggatcagtgaaccagcccagcacccaccaacaactgctccaaccccaacaaatccggcaccttcgccacctgttccccgacctgcaccgccgcctgctccaacccacacaacggcacatcgacataactcaactgactgtcgagcttgtacgaccgcggaatcccctgcaccagcagcgcaatgaacttcagctccggcaacccgccgagggcattgaggatgacaatccgcgcgcgctcgccaatgacaattttctgcccgcacgccgactcaaaactcagcaacggaatctgccgctcgcgccacttcacccgccccagataccaaggcggcgtatcgagatcgaaggcactggcctgatagtcaatcaactcagcgacagcgacgttaggcaaaatcaaattgcgatccgccaacggcagcagcaacccggtcagctgactgctgcgctgattatgccggcgctcatgcatgtttcttgctccactgggcaatgctttcaagcagcaccgactcttgatacggcttgccgaggtagtcgttgacgccaatcgccatggcgcggtcgcggtgtttctgcccggtacgcgaggtgatcatgatgatcggcaggtgttgcaggcgttcgtcgttgcgcacctgggtagcgacttcgaagccgtccatgcgcggcatttcgatgtcgagcagcatcaggtcaggcatgtgttcttccagcagtagcatggcgtcgacaccgtccttggccgtcagcacgttcataccgtggcgttcgagcaagcggctggtgaccttgcgcacggtgaccgagtcgtcgaccaccatcaccagcagcggtttgtgtggttcgctgtcgatctccggcagcgtcggtgtctgcgcaactcgcgcctgcatcgcgcggattggcgcgagcagatcgagaatcagcaccacccggccatcgccgagaatcgtcgcgccggacacgccctgcaccgcagcgaattgcgcgccaaggcttttgaccacgatctcgcgggtgccggccatggtatccaccagcaccgcgatgcgccggtcgttgtagtgcaccagcagcaccggcaacggcaggttctgccccagcagtttcggtcgtggcgcggttttcagcagttcgccgaggtagcacagttcataggtctggccgccgtactggtaacgcggcggatcaacccggaagtgcgcttccagatcattcggcaacacgcgaacgatgccttcgatggtgttcagcgggatcgcatattgatcctcaccgcactgcaccatcagcgcacggttgaccgacacggtgaacggcaggcgaatgcggaaatgcacgccctgccccggcaccgagtcgatgctcatgctgccgcccagttgccgcacctcttcgtgcaccacgtccataccgacgccacgtccggaaatctgggtgatcttctccgctgtggaaaaccccggttggaggatgaactgcaacacgtcgcggtcgctgatctcggcttccggcgcgagcatgccacgcttgatcgccttgcgccgcaccgcttccagcggcaccccggcgccgtcatcgcgaatatcgaaaacgatgtcgccgccctcgcgggacaggtcgaggctgatctgcccttgcgccggtttacccgccgccagccgcacttcggcagactccagaccatggtcgacggcattgcgcagcatgtgttccagcggcgccgccatgcgttcgagcacattgcgatccatctcgccttcggcgttgccgacgacaaacgcgacgtctttattcagctcttcagcgacctggcgaacgatgcgtttgaggcgcggcaacatgcgctcgaacggcaccatgcgcgtacgcatcaggccttcctgcaattcggtgttgatgcggccctgttgctgcaacaggttctcggcgtcgtggttgcggcggtcgagggtttccttgaggtcgagcaagtcggatgccgattcgaacagcgctcgcgacaattgctgcaactgcgaatggcggtccatttccagcgggtcgaattcttcgtaaccgaggcgttcggcgtcgacttgctggcggctgagaatccgcccctgggtttcggtgtcgagacggcgcagctgatcgcgcatgcgttcgatggtggtttccatctcgttcagggcgatctgtgcgtcgttgacctgctgttcgatacggccacggaagatcgaggtttcgccggccagattgaccagctcatcgagcaattcggcggagactttgaccatgtccgcgccagcctcggcagccggcggtgcaggttcggtcttggcgggcagcggcaacgctggcggtgtttcgaccgttaccggatggctgaaattctggatcgcgttgatcagccgatccgctggcggacacggttgcccggcgcgcacgccatcgagcatttgcgccaagcgatcatgcccgcgctgcaccagcgcaaacagctccgccgacggctgcaaagcgccgctggaaagactttcgtaaaggtattccagctcatgggcgaggtcgccgatcgggccgatctcgaccatccgcgcgccgcccttgagggtgtgcagatcgcgcagcagggtttccacctcctgacgattgcccggctcggcctgccagcgcagcaatgcggcgccagagttttcgatgatgtcgaaaccttcttcgaggaagatctccagcagctccgggtcgtggccggcgctgtcgtgatcaatcgttgctggcggcgtttcggcgacgattgggccttggcgaacctgacgaatcgcgtcgatcagatcctgcgccggggtcagcggctgatggttttgcaactgatcaagcaacagcgccaagcggtcatggctcttgagcagcaagcgccccaggctttcgttgtggtggtagcgacgatcgaccaaaccttcgtaaaggctttccagctcttgagccagatcgccgatggcctcgacttcagccatccgcgcgccgcccttgagcgtatgcaaatcgcgctgcaacgaggacagcggcgcaacgttatccgggtcgttcagccagcgctgcagggcttggcctgagctgtcgagaatgtccaccgcctcttcgaggaagatctcgacgatctcgtcatcgggctcaagcgccgttgccttttgctgcaactcggcggtggcgctgcccagttcacggatgctcagggtgcggctgccatcgctgcgaatcaggcccatcgacgacgggtcgagactctcatcgagcaggtcatgcagggcccgaatccgcgctggttgcggcgtgacttcctgcccggcggccagctcgtcgagcatgttgatcagcgcttcatgggcgttttgcgcctcctggaaaaaccgctcgctgaccgcaaggctgctttcttccaccgcgccatacaggtcgagcaaggcttcacagagcacatcgaccggcagcagatcggccatgtgcgcgccttcgccaagggtggtcaactcatccagcaaggcgctgagttcctgacgctcgccggggtgttgctgccagcgctgcaagaggttttccgcgtcgaggaggatgtccatgccttgggcgaggaagttgttgatcagttgtggatcgcgcttgatccgcaggccggtgttcggcgcattgaggatggtttccaggcgctcggcgagcagtgtgtcggtgcgtttgatcagcgactgcgcaccgacaatcggcgccagcggatcatgcttgagctggcgcaagccgatacgaaacaggccttcggcttccagcagcaattccacttcatcgaggtccagcggcaactgatgcgccttgaactcccgagccaattgatcgagcgatgcggccagttcggcaatcggcaacacgcctgccatcgacgcgctgcccttgagcgtgtgcagtgcgcgctgcaattcgtcgctggcctgcaacggcacatgctcggcggcctgatcaaggaagcgattgaggctggcgaggtgggtctcggcttctttgcggaagatctccagcaagagcggatcgagcgccgcgacatcgtcgacgtcttcggcggccagcggctcgtcccccttggccaaggcgtgagcgcgtgcagcgagttgatcgacatcgctgcgctgccgttggctgttggtggcgaattcgctgatcaactcgggcaacaacagcacggtgtcggtcagcacttgctgcaccaccgatcccggctcgacactttgttcaagcacacggttgagcaggttttccaccgaccaggccaactcgccgagaatcagcgcgcggaccatgcgcccgctgcccttgagggtgtggaaggcgcggcgcagttcagtcagcgcatcgcgatcctgcgaattggcgatccagcgcggcaggtattcgtggagaacttcgaggacctcatcggtctcttcgaggaacacttcgcgcagttcatcgtcgaccggttcttcatcggccggcggcggcatcaggctgccgggggtgatcagggccggcgggttgagcgctgaaaccgggctggccagaacgtcggccagcgactgcacgatttccgggtcatccagcgcctgcatgtcctgcatcaccagcgcttcgctcgggctgaggacatcatcgagtactggcacatgcggcgcgccgggctgttcatcgggaaagaaaccgagactggcgagggatttctgcgcgacatccagcagttgttcgccgggggcctgcggatcgtcgctcaagcgttcgaggtaatactcaaggctgctgatgacatccgccagatgatccagttgctcccagcccggctcatgcggatcgattagcaaatgttcgcggataaaaccgttgcacgcctcgacaagactcgccgcgcgattcaacggaatcatcgccagcgcaccgcgcacctgagtcagcagcgccggcaacggttgcagttgctggcgatcccaatcggcgtcgatgtaatcgacgatcatgtccttggcctgttgcaggcagatgcgcgcttccttgatcacgatctggtgaatctgcgtcaggtctgtggttggcaggcgcgcgtcttccggattttccggctcgacggtgccgaccattccggccagcgtcgcttcgacgtagagcagcgcgccggcaacatccatcaggatcgcgtcgttcggttcgcgctggccttgggcaaggctgagcaccaccgccaattgatcaatgatgactttgcgcggctgaccaaaaccgagcacggcgagggtgtcggcgatctgccttaatggcgcgagcaggctttccagatccgaagtgtgctggcggtcgctgcgcacgaacaggtcgaggcgttccttgacccgcaccagttcctcacacagtgcagccagcaccgagcgcatcgcatcgcggtcggggccggccaggcgcgcgcgttcttcatcgaccatcgcactgtcgggcaacgcgtcgtccagggagtagcgatctttcatggtcagcatctgcccggtgggatgttcggctttggcaatatagaacaacaggcttttcagcagctccgccggcgccggttgattaaggccggacaggccttgctcgagcaggcgcttgagttctttgtcggcgtccttgaacaggctgcgcagcgccggactgttggcgatcacgcctgcgcgcatgccttcgaccagcgccgaggcgacctgccacaacgggctcaggggcgaatcaccgctcagcgcttcgaggcgggtgaagactttggccaaatattcgaggtgcgtctggtcatcttgttcgcgcagtaaaccgaccagcgccatttgcagcatctggcgtaatttgcgcagtacgttcggcagttccgtcggttcgagcagtgccagttcgtcggcccgcagcggcgccagttcggggagctgcgggctgaacagactggtttccgagagcaggctttcgccccgggcgctgcgcagatcgttgatcagcggcagcaccactaacggcaaatcacgccgagcgctctgcacgcggtcgaggtagaccggcaattgcccgagggcttgcagcaacaggtgcagcgcttcgtcgcgatggctgacgcgctcgtgctgcagggcttcgaccagatgttccatctcttcggcgagcaaggctgcgccgtagaactcgaccatctgcaggctgccgtggacctgatggatgtaatccaggcactcgtccagcccgggaaaggcctgcggatcatcgagcacggcttcaatcgcctgatgcgcgagcctcagcgtttcggcaatttcgcctttgacccattcgagggccacatagtcgtgccgatcacccataaccactccactcacgctttatctgtcgccgccggcaaggtgaatccggacaccgagcgccgcagctgactggccatcttcgccaggttgccgatgctttcggcggtggccgtggagccggacgaggtctgcgaggtgatctgctggatcacgttcatcgtcagcgagatctgcccggcggaagtcgtctgctgctgcgctgcattggagatgctttgaatcagcgccgcgagggtcttcgacacaccttcgatttcttccagggccacaccggcatcctgcgccagtcgcgcgccgcgcaccacttcggtggtggtttgctccatggaaatcacggcttcgttggtgtcggtctgaatcgcccgcaccagggtttcgatctgccgggtggcggcggacgagcgttcggccaagcgctgcacttcgtcggcgaccacggcaaaaccgcgcccggcatcaccggccatcgacgcctgaattgccgcgttgagggcgaggatgttggtctggtcagcgatgtcgtcgatcaggctgacgatgtcgccgatttcctgcgacgactcgccgagacgcttgatgcgtttggcagtgtcctggatctgttcgcgaatgttgtccataccgtggatggtgttgtgcaccacctcgttgcccttgttggcgatctccacggagcgctcggcgactgccgaagattcggcggcgttggccgagacctgatcgatggactcggccatgtcgctgatcgccgtcgaggcttcggaaatctgctgggcctgatgctccgaggcctgggccaggtgcatcgcggtggcctgggtttcctgcaccgctgcggcgacctggccggcggtgaggttgatggtcgcaaccagatcgcgcagttggtcgacggagtagttgatcgagtcggcgatggtgccggtgaagtcttcggtcaccgaggcggtcacggtgaggtcgccatcggcgaggtcttcgatttcatcgagcagacgcatgatcgcattctgattgcgctcgttcttctcggcggtttcgcgcagttgccgattggtttcccggaccatcaccagaccgatgaggatgatcgaggccagcgccagcaagcccaaaacgtagccaccgatggtgtcggtgttgcgcccgccggcaaggttctcaaagcgagtggccaggtgcgaggcttcgtcgagcagggtttgcgagaggctgaaaatgttgctcgccgattcacgcaccttgaacagctctggcgaggtctcgaggatttcatccaccgagccggaaacgaactggaacagctcggagatttcactcaggcgcgcacgggcatcacggtcctccacttggctgattttcagcgtcgggttgccttgcagcatgccgttgagcacttggccgaaacgggtggcgtcgcggccaaaggcatcggcggcttgctgcgagttttcgtcgccggcgagcacggtgttgaccgcgccgagaatgcgttcagccagcaacgactgacgttgggccatcgccacttgcgcggccggtgcaccacgctgaaggaggatttcgacgactttttcgtattcgatctgcaactgcggcacggtttcggccagggtcgcggcgacctgatgcagcgacagcacggtctgttcgctggagagaatcgcgtcggtatttttcagcaggcgttcccagtcgagctgcacggcgcgcatttccgggcgcacggtggccggtgctggcggcaggccagtggccggatcaccttttttcaggtaaccccagcgctgggcgaaatcgttgcgcgcatcgctgagcagcttgaacgcggcagccttgccggcggcggcttcggtggcgttcttggcaatgcgttgcgagagcacgcgcagctcaccggcgtggccgatgtactgtttgtcgtagttcgcctgggtgttgaggtaagcgaagttggcgaacagcagcatgatgaacacgatcagtgcgatgaacagcacgatgatctgcgagcgactgcgcgatccttccgccggcttgcctgtttttgcttttatcatcggtcctcgcctgtttgaagctcaccggtagaacctgtaggagtgagcctgctcgcgattgaacgataacgcggtgtacttgatacaccgcggtgcctgaatcgcgagcaggctcactcctacaagggatctttgttgtaacggctatatcgcgacgctcatgaacaccggggatttcgccaacgcgaacaagctgaacacccgccagttctgctcacggcggaaatagcctttgacgaactcggccttggagccctggcgcttgctgatcgagatcggttcgaagctgtcctgctcgaaatgttgcaagccaataacctcatcgaccatcagcccggcaaacacatcgccatgctcgaccaccaatacccgccgctgtttacgcagcggcgacagctcatgcccgaagaacccgcacaggtccatgatcggcagcagccgcccgcgcaggttagccacgcccttgacccacggcttgaccccgggcaattgagtgaagcgcggttcgtgcagcacttcgctgacttcgcccatcggcgccacataccaatgctcgccgaggcgaaagccgatgccgctccagcgatcctgccgcgccggttgcgacggcaggtccgccgccagcaagcggcagcgctggtcgatttgccagagcagttcgaacgcggtcagcgattcgctcatggtcgcgcgatcagcctttgagtacgttgttcagggtcttgatcagggtgtcttcatcgaccggtttggtcaggtagtccttggcgccctgacgggtgccccagaccttgtcggtttcctgatccttggtggtgatgatgatcaccgggatgtggctggtgtcggcatccttggtcaactggcgggtcgcctgaaaaccattgagaccgggcatgacgatgtccatcagtaccgcgtcgggtttttcctgacgggccagggccacgccatcggcgccgttttcggccttcaacacttcatgaccgtgcttttccagcatgccggtcagtttgtacatttcagtcggcgaatcatcgacgatcaggatacgtgccatggttttccccatttttcttgtcgacgcgcggcccgctggccgagcgtcactgtacgtgtcttactgcggcaaaacggcggcaaagcccggaacatgggcctgaatcgcgttgagcagttcttccttgctgaaaggcttggtcaaaaattgatcagaaccgacaatccgccccttggccttgtcgaacagcccgtcacgcgatgacagcatgatcaccggcgtagccttgaacgcactgttgttcttgattaaagcgcaggtctgatagccatccagacgcggcatcatgatgtcgacaaaaatgatcccgggatggttgtcggcgatcttcgccagggcgtcgaaaccgtcgatcgccgtgatcacttcgcaaccgacattcttcaacaatgtttcggcggtgcgacgaatcgttttcgagtcgtcgatcaccatgaccttcaaggcgctggactgctgttccataagagggctctaccgtcgcctttgcgaatcaaattgtccgttttgcgatgagtaatggctggaaacccttgatgttcaagggccagcaccgcttggcagtctttttagcacagtctccagatgcaatctatcgacgggtttttccttgaccgaaaacccgcccggcgccactctggcggcactttttcaataccgatccggtagccaattttcgaggaaaacccaatgagcgttcgcgtcgggattgtcatggaccctatcgccagcatctcctataaaaaggatagctcgctggccatgctgctggccgcgcagaagcgtggctgggaactgttctatatggaacagcgcgacctgtatcagggtgaaggtcaggcccgggcgcgcatgaagccgctgaaagtcttcgccaacccggaaaaatggttcgaactggacgccgagcaggacaacctgctgagcgatctcgacgtgatcctgatgcgcaaggatccgccgttcgacatggagttcgtctactccacctacctgctcgaacaggctgaaaccgctggcgtactggtggtgaacaagccgcagagcctgcgcgactgcaatgaaaagctgttcgccacgctgttcccgcagtgcacgccgccgaccatcgtcagccgccgcgccgacgtgctgcgtgagttcgccgccaaacacggcgacgtgatcctcaagccgctggacggcatgggcggtacttcgattttccgccaccgcgccggtgatccaaatctgtcggtgattctcgaaaccctgaccgccctcggtggccagcagatcatgggccaggcttacctgccagcaatcaaggacggcgacaaacgcatcctgatgatcgacggcgagccggtggattactgcctggcgcggattccggcgcagggcgaaacccgtggcaacctcgccgccggtggccgtggtgaagcgcgtccgctgactgacaaggatcgctggatcgcggctcaagtcggcccgaccttgcgcgaaaaaggcctgctgttcgtcggtctcgacgtgattggcgaaagcctcaccgaaatcaacgtcaccagcccgacctgcatccgtgaaatcgacaatgcgtttggcaccgatatcggcggcatgttgatggatgcgatcgccaagaagctgcaagccgccggcaaaatgccacaagcttgatgcacgtcacatgcagtctgtcgcttgaagcgtgaagcccaaggcgtgaaaccaacattgcgttatcatgcgcagcctctgaaaaacgcgatgttggttttcttgtcatgaccctcccgtccgatctgcccgcagaactcgcccaccgtggcgtgcgcccggccgatcgcctcggatttaccctgtttcttgcggcgctgatccacttggcgctgctgctcggcatcggcttcacgatggtcgagcccaagcaaatcagcaaaaccctggaaatcaccctcgccaccttcaagagcgaaaagaagccggagaaggctgactttctcgcccaagaacatcaggaaggcagcggcacgctggacaagaaggcgattccaaagaccaccgaggtcgcgccattccaggacaatcaggtcaagaaagtcaccccgccaccggccgccaagccgcaagtgcaggaagccgcgcccaaggctgcggtgaccaccgttgcgccgaagccgaaaaaagcaccgaccaagaaagaagaaaccaagaccgaggtcaaaccgacggtcgacgcaccggagttcgatagctcgcagctgtccagcgacatcgccagcctcgaagccgaactggccaaggaacaacagctgtacgccaagcgcccgcgtattcaccgcttgagcgcggcgtcgaccatgcgcgacaagggtgcctggtacaaggacgactggcgcaagaaggtcgagcgtatcggcaacctcaattaccccgaagaagcgcggcgcaagcagatctacggcaatttgcgcctgatggtctcgatcaaccgcgacggttcgctgtatgaagtgctggtgctggaatcgtccggccagccgctgctggatcaggcggcgcagcgcattgttcgactggcggcaccgtttgccccgtttaccggggacttgtcggatatcgaccgtctggaaatcattcgtacctggaaattcgcccggggcgacaagctctccagcaactgacacaccacagcccccctgtaggagtgagcctgctcgcgatagcggtatgtcagaacctgaacatttgactgacacaccgctatcgcgagcaggctcactcctacagttgatcggtgtgttgcttacatctccagcttgtcagtttgccccccgaacgccacactagcgcacatgaaaaacgtcagccccagctacctcaagcatcaattcctgatcgccatgccacacatggccgacccgaactttgcccacaccttgacctacatcgtcgagcacacggccaatggcgcaatgggaattgtggtcaacaggccgcaagagctgaacctggccgacattcttgagcagctgcgcccggacatcgacccgccagcactctgccagcacgtgccgatcttcatcggcgggccggtacagactgatcgcggattcgtcctgcacccggccgggaaaaccttccaggccaccgcacagctggacggcgatctggccctgtcgacctcgcaggacgtgctgttcgccatcgctgacggcgtcggcccggcgaaaagcctgattgccctcggttacgccggttgggaagccggacagctggaagcggaactggccgacaacgcctggctgaactgcccgtacgacgccgatatcctgttcaacaccagcagcgaactgcgtctggaagcggcggccaggcatttggggatcaacctcagcctgctgaccagccaggcaggacacgcctgatggccctgcgcctgattctcggcttcgactacggcaccaaacagatcggcgttgccgtcggtcaggtgatcaccggccaggcccgcgagctgtgcaccttgaaggcacagaacggcgtgccggactggaaccaggtcgaagcccttataaaagaatggaaacccgacgccgtcgtcgtcggcctgccgctgaacatggacggcacgccaagcgacatgtgcgtacgcgcggagaaattcgcccgccgcctcaacggccgcttcaatgtgcccttctatacccacgacgagcgcctgaccaccttcgaggccaaaggcgaacgcctggcccgtggcggccagaaaggcagttaccgcgacaacccggtggacgccatcgctgccgctctgctgttgcagggctggctcgatgaaaacactgcattgtttgaatcctgacaagcgcttcggcgcttttcttttgagtgaaaaaccgagtcgtgtccaaggaccctactcgcccccaacaaggagcaaccatgagcctgccaaatcccgccgatctgatcagccagatggcaacccgcctcaaggcgcaccttgcccagcgtgacatcagtgaaccgcgttacatcggcatccgcaccggcggcatctgggtcgcgcaggccttgctcaaggaactgggcagcgacgcgccactgggcacgctcgatgtgtccttttaccgcgacgacttcagccagaacggtctgcacccgcaagtgcgcccgtccgccctgcccttcgagatcgaaggccagcatctggtgctgatcgacgacgtattgatgagcggccgcaccatccgcgccgccatgaacgaattgttcgactacggccgcccggccagcgtgaccctggtctgcctgctggacctcgacgccggcgagctgccgatccgcccgaacgtggttggcgcaaccttgtcgctggccgcccacgagcgggtgaagctgtccggccccgagccgctgacgctcgaactgcaagacttcaacctttaatccgccctattgagagtccccttcgcgatgacgcctctagataccaagcgcccgctgcagctcaatgatcagggccagctgcgccacttcctctcgctcgacggcctgcgccgcgagttgttgacggaaatcctcgacactgccgactcgttcctcgaagtcggtgcccgggcggtgaagaaagtcccgttgctgcgcggcaagaccgtgtgcaacgtgttcttcgaaaactccacgcgcacccgcaccaccttcgaactggcggcccagcggctgtcggcggacgtgatcaccctgaacgtgtcgacctcgtcggcaagcaagggcgaaaccctgctcgacaccttgcgcaaccttgaagccatggccgccgacatgttcgtcgtgcgccacggtgattctggtgcagcgcacttcatcgccgagcacgtttgcccgcaagtggcgatcatcaacggcggcgacggccgtcacgctcacccgacgcagggcatgctcgacatgctcaccatccgtcggcacaagggcggtttcgaaaacctctcggtggccatcgtcggcgacatcctgcactcgcgggtggcgcgctcgaacatgctcgcgctgaagaccctcggttgcccggacatccgcgtgatcgcaccgaaaaccctgctgccgatcggcatcgagcaatacggcgtcaaggtttacaccgacatgaccgaaggcctgaaggacgtcgacgtggtgatcatgctgcgcctgcagcgtgaacgcatgaccggcggcctgttgccgagcgagggcgagttctaccgcctgttcggcctgaccaccgcgcgtctggccggggccaaacccgattgcatcgtcatgcacccggggccgatcaaccgcggggtggaaatcgagtccgccgtggccgacggcccgcactcggtgatcctcaatcaggtgacctacggcatcgcgattcgtatggctgtgctgtccatggccatgagcgggcaaacggcccagcgccaattcgagcaggagaacgcccagtgaagctcagcattctcggcgcacgcgtcatcgatccaagcagcggcctggatcaaatcaccgacattcacgttgaagcctgcaagatcgtcgccctcggcgcggccccggccggtttcagcgcagtagaaaccatcgacgcccaaggccttgtcgccgctccgggcctcgtcgatctgaatgtggccctgcgcgagccgggctacagccgcaaaggctcaatcatcagcgaaacccgcgctgctgcggccggtggcgtgaccagcctgtgctgcccgccgaaaaccaaaccggtgctcgacacctccgccgtggccgaactgatcctcgaccgcgcgcgcgaagccggcaacaccaaggtgttcccgattggtgcgctgagcaaaggtctggacggcgagcaactggcagaactggtggcgctgcgcgatgccggttgtgtggcgttcggcaacggtctggagagtttccgcaacacccgcaccctgtgccgggcgctggaatacgcggcgacgttcgacctgacggtgattttcaactcgcaggatcacgatctggccgagggtggtctggcccatgaaggcgcagtagccagtttcctcggcttgcccgggattccggaaaccgctgaaaccgtggcattggcccgtgatctgctgctggtcgagcagaccggcgtgcgtgcgcacttcagccaattgaccagcgctcgcggcgttgccttgatcgcgcaggctcaggcccgtggtttgccggtaacggcggatgtcgcgctgtatcagttgattctgaccgacgaagcgctgatcgacttcagcagcctgtatcacgtgcagccgccgctgcgtacgcgtgctgaccgtgatggcctgcgtgaagcagtgaagtccggcgtggtgtcggcgatttccagccatcaccagccgcacgaacgtgacgccaaattggcaccgttcggcgcgaccgaaccgggcatcagcagtgttgagctgttgctgccattggcgatgacgctggtggaggatggcttgctggatctgccgaccttgctggcgcgtttgagcgctggcccggctgaagcgctgcgcttgccggcgggcaaactggcggtgggaggggcggcggatatcgtcctgttcgatccgcaggcttcgacagtggccggtgaaggctggctgtcgaagggtgagaactgcccgttcattgggcacactttgccgggtgtggttcgctacacgctggtggatgggcggatcagtcaccaggcttgataccgggttgagccgatcgcgagcaggctcactcctacaggggatttgtgtcgttcacagatcccctgtaggagcgagcctgctcgctaagacttactggaaggcgcctctgccttcggcgttacgcaccgagacctgatcattcagcgtccagaagtcatacagcacgccaagaaagaacaacccgcccgtcagcagataaatcagtccgctgatccatttcccctgatacatccggtgcacgcccaatgctccgaggaacgtcagcagaatccacgccacgttgtattcgatcggccctgcggtaaaacgcagatccgcctcgcgatccatcgccgggatcaggaacaggtcgatcaaccagccaatccccagcagaccgaaggtgaagaaccagatcgtcccggtcactggcttgccgtaatagaagcggtgagcgccggtaaaaccgaaaatccacagcagatagccgatgactttgctgtgtgtatcttgcggctgtgcaatttgttgatagcggttcatgaagacctcgattcacacgatagataaatattcttgaattctttgtgacttttttacaggtagccgacgtacggcaaatgttaccgttgctaccgtcaaagccttatagcacctgacttctgtccgacaattgcgtccatttgccgcttatttggttccgttggctgccaactgaatcgaccaacggactcggaatgaaaaaaactctgttataaagttgcgcgctatcactgaagagccacgcctaatgcgaccatttttcaagacatggctgaccatctgcctattaatgcctctggccgcccacgccaccaatcgtgagcaacgtcttcctaacgttaacggctttactcctaaatcccatgcttcggctccttcgagcaaaagcagcaaaagcaaaaccaccacgctgagcagcaagagccacagcaagctggtgccaccgatggcgagcaaggaaagcagcaacgtgctgagccgtgcggtaaacgtcctcggtacgccttatcgttggggcggcagcagcccaagtaaaggtttcgattgcagcggtctggtgaaatacgcgttcaacgacgccacgttcgacctgccacgcacctcgaatgccatggccagcggccacggcgagaaagtcgagcgcaaggatctgaagccgggcgacctgattttcttcaacatcaagagccgtcgggtcaaccacgttgccatctacctgggcaacgaccgcttcatccacgcaccgcgtcgtggcaaagcggtgagcatcgacacgctgaacaagccgtactggcagcagcactacgtggtggccaagcgtgtgttgccgaaagaacagagccagatgcgcgtggttcagcgctaacaccaaccgatcgttcccacgctccgcgtgggaatgcctcaatggacgctccgcgtccgcttcggcagggacgcagagcgtcccgggctgcattcccacgcaaagcgtgggaacgatcactccctcagaaattatccggcgtgcgcgccttctcccgcgcatgctcgcggctgatcaagcccttggtcaccagatccttcaggcacatgtccagtgtctgcatccccaacgacccaccggtctgaattgccgaatacatctgcgcgaccttgtcctcacggatcaggttacggatcgccgacgtgcccagcatgatctcgtgggccgccacccgcccgccgccgatcttcttgatcagcgtctgcgagactaccgccagtagcgactccgacagcatcgaacggaccatcgacttctcgtcaccggggaatacgtcgaccacccggtcaatggttttcgccgctgaggtggtgtgcagcgtgccgaacaccagatgcccggtttccgcagcggtcaacgccaggcgaatggtttccaggtcacgcatctcgccgaccaggatcacatccgggtcttcacgtagcgccgagcgcaaagcagtggcgaaactgcgggtatcacgatggacttcacgctgattgatcaggcatttgcgcgattcgtgaacgaattcgatcgggtcttcaatggtgaggatgtggtgatgccggtgggtgttgaggtaatcgatcatcgccgccagcgtggtcgacttgcccgaaccggtcggcccggtgaccagcaccagcccgcgcggggcgtcggtgatcttgcgaaagacatcgcccatgccgaggtcgtccatgctcagcactttcgacggaatggtccgaaacaccgcgccggcaccacggttctggttgaaagcgttaactcgaaaacgcgcgacaccggggacttcgaaagaaaagtcggtttccagatgtttctcgaagtcgacccgctgggtgtcgttcatgatgtcgtagatcaattcgtgcacttgcttgtgatccagcgccggcagattgatccgccgcacatcgccatcgacgcggatcatcggcggcagaccggccgacaggtgcaggtcggaagctccctgtttggcgctgaaggccagcagttcagtgatatccatagcgctcctcaattccagtagaatgccgcgaaccttcagaccgccggcgcctcttgatgtccacgatagcagacaacattcttcaggttggttcgcgcatccaggcagcagccaacgctgcgaaccgcgacgaaaacagcattcagttgctcgccgtgagcaaaaccaaacccgccgaggcgttgcgcgaagcgtatgccgccggcctgcgtgactttggtgagaactacctgcaggaagcctttggcaaacagctcgaactggccgacctgcccttgatctggcacttcatcggccccattcaatcgaacaagactcgtgcgattgccgagcatttcgactgggtgcattccgtggatcgcctgaaaatcgctcaacgcttgtccgaacagcgcccggctgaactgccgccgctgaacatctgcattcaggtcaatgtcagcggtgaagccagtaaatccggctgcaccccggcggatctgccggcgctggccgaagccatcagcgccctgcctcggctgaagctgcgcggcttgatggcaattcccgagccaaccgaagatcgcgccgagcaggacgcggccttcgccgccgtgcagaaattgcaggcaagcctcgatctgccgctcgacacactttccatgggcatgagccacgacctcgagtcggccattgcccaaggcgccacttgggtgcgtatcggtaccgccctgtttggcgcccgtgattattcccaatcttgaacgtttccagataaggaccacacatgagcaacacacgtattgcgtttatcggtgcgggcaacatggcggccagcctgatcggcggcctgcgcgccaaaggtctggaagcggcgcagatccgcgccagcgatccgggcgaagaaacccgcgccaaggtcagcgctgaacacggcatcgagaccttcgccgacaaccctcaggccatcgacggcgtcgatgtgatcgtactggcggtcaagccgcaggcgatgaaagccgtgtgcgaggcgattcgcccgagcctgaaaccgaaccaactggtggtgtcgattgctgccggcatcacttgcgcaagcatgaccgcgtggttgggcgaacagccgatcgtgcgctgcatgccgaacaccccggcgctgctgcgtcagggtgtcagcggtttgtatgcgaccagcgaagtgaccgccgaacaacgtcagcaagccgaagagctgctgtccgccgtgggcatcgctctgtggctgaatgaagaacagcaactggacgcggtcactgcggtgtccggttccggcccggcgtacttcttcctgctgatcgaagccatgaccgctgccggcgtcaaactcggcctgccgaaggacatcgctgaacaactgactctgcagaccgccttgggcgccgcacacatggcggtttccagcgatgtcgacgccgccgaactgcgccgtcgcgtgacttcgccaaacggcacaaccgaagccgcgatcaaatcattccaggccaatggctttgaagccctggtcgaaaccgcactcggcgccgccgcgcaccgctcggccgaaatggccgaacaactgggcaaataaggagccttacatgattggattgaacactgcagcggtttacgtgctgcaaaccctcggcagtctgtatttgctgatcgtgctgctgcgcttcgttctgcaactggtacgggcgaacttctacaacccgctgtgccagttcatcgtcaaagccacccagccgctgctcaagccactgcgccggatcatcccgagcctgttcggcctcgacatgtcgtcgctggtcttggcgattctggtgcaactggcgctgatggcgctgaccctgctgctgacttacggcaccaccggtaacccgctgcaactggtgatctggtcgctgatcggggtgaccgcgctgttcctgaagatcttcttcttcgccctgatcatcagcgtgatcctctcgtgggtcgcgccgggcagccacaatccgggggctgagctggttaatcagatctgcgaaccggcattggcgccgttccgcaaaatcctgccgaatctcggcggtctggatctgtcgccgatcttcgccttcctggcgctgaagctgatcgacatgctggtgatcaacaatctggcggcgatgacgatgatgccggaaatcctccgtctgctgatgtgagctggtttcgatgggacggtgacgacttgatcctcgagtgtcacctgcaaccggcagcccgcagcgatgacttcgccgggctgcacggcgatcgtctgaagattcggctgactgcgccgccggtcgagggcaaggccaatgcttacctgatgggctttctggccaaggcatttggcgtttcgaagagccaggtcagtttgctcagtggtgagttgaaccggcagaagcgggtgaagatctgctcgccgaagaagttgccggatttgccggggttggttgggcgcttgtcttgagttttgcggcgtctgtgcccctcaccccagccctctccccctggagagggagccgatctagggtgttctcaaagcttgagttcgactcgatatcccacgtcggcgtatctcgaacatccaccccagtcagtccccacttcctccgggagagggagccgattttggtggttttcaaggcctgagttcgactcgatagatcaggtcggcgtagctcaaaagaacacctcggtcggtcccctctacctctgggagagggctagggtgagggccgcttgccgctaacccccccggtctttagacttacgcctcatttcaacgagagcagggtcgatgccaactgcctttccccccgattctgttggtctggtgacgccgcaaaccgcgcacttcagcgaaccgctagcgctggcctgtggccgttcgctggccgcctatgacctgatctacgaaacctacggcacgctgaacgcgcaagcgagcaacgccgtactgatttgccacgccttgtccggtcaccaccacgccgctggctatcacagcgtcgacgaccgtaaacccggttggtgggacagctgcatcggccccggcaaaccgatcgacaccaacaagttcttcgtggtcagcctgaataatctgggcggctgcaacggctccaccggcccgagcagcatcaacccggagaccggcaaaccgttcggcgccgacttcccggtactcaccgtggaagactgggtgcacagccaggctcgcctcgctgatctgctcggcatcggccagtgggcggcggtgatcggcggtagcctgggcggcatgcaggcgttgcaatggaccatcacttacccggatcgcgtgcggcactgcctggccatcgcctcggcaccgaagctgtcggcgcagaacatcgccttcaacgaagtcgcgcgccaggcgatcctgactgaccctgagttccacggcggttcgttccaggaagccggcgtgatccccaagcgcggtttgatgctcgcacgcatggtcgggcacatcacttacctgtccgacgattccatgggcgagaaattcggccgtgggttgaagagcgagaagctcaactacgacttccacagcgtcgagttccaggtcgaaagctacctgcgttatcagggcgaagagttctccggacgcttcgacgccaacacctatctgttgatgaccaaggcgctggactacttcgatccggcggcgaacttcgacgataacctggcgaaaaccttcgaaaacgccacggcaaaattttgcgtgatgtcgttcaccaccgactggcgcttctccccggcccgctcgcgggagctggtggatgcgttgatggcggcgcgcaaggacgtcagctatctggagatcgatgcgccgcagggccacgacgccttcctgattccgatcccgcgctacttgcaggcgttcggcaattacatgaaccgcatcacgttgtgagaaagccatgagagctgatctggaaatcatccaggaatggatccccgccggcagccgcgtcctcgacttgggctgcggtgacggcgagttgctgacctggttgcgcgacaacaagaacgtcaccggttatggcctggaaaacgacgccgacaacatcgccgagtgcgtggccaaaggcgtcaacgttatcgagcaggatctggacaaggggttgggcaacttcgccagcaacagtttcgacatcgtcgtcatgacccaggccctgcaagccgtgcactacccggacaagatcctcgacgaaatgctccgggtcggtcgccaatgcatcatcaccttcccgaacttcggtcactggcgctgccgctggtacctggcgagcaagggccgcatgccggtctccgagtttctgccgtacacctggtacaacacgccgaacatccacttctgcaccttcgaagactttgaagaactttgccgcgaacgtgatgcgaaggtcattgatcggcttgccgtggatcaacagcaccgccacgggtgggccagtaagctatggcctaatctgttaggtgagatcggtatctaccgcgtcagcagcccgcagcttgcagaccacaaagtcgcggtctgaatcccgtcatttcgaggagacgatcatgggtcgtttagcgttgttgttattgactgcctgcctgagcgccagcgctctggcggccgacgtcatcaagggcgaacgcaaggaaacctttggcgacgtcacggtgcactacaacactttcaactcgacgttcctgcaaccggacatcgccaaggccgcggagctgatccgcagcaagcatcagggcgtgatcaatgtctcggtaatcaaggacggcaaaccgttgatcgccaacgtcaccggcacggtcaaagacctgaccagcaacagcgtgccgctgaatttccgccagatcaccgaacagggcgcgatctactacatcgcccagtatccggtggaacagcaggaaacccgcacctttgaaatcaaggtgcagaacggcgacaagatcaacaccatcaatttcaaccaagaactctttcccggcgaatgatgaacatcaagcagctcgtactggccagccataacgccggcaaactcaaagaactccaggccatgctcggcgactcggtgcaactgcgctcgattggcgagtggagcaaggtcgagccggaagaaaccggtctgtcgttcgtcgagaacgcgatcctcaaggcacgcaacgctgcgcgcatttccgggctgccggcgctggccgatgactcgggtctggcggtggatttcctcggcggtgcgccgggcatctattcggcgcgctatgccgatggcaaaggcgatgcggcgaacaacgcgaaactgctcgatgccttgaaagacgtcccggaagcagagcgcggcgcgcagttcgtctgcgtattggcgctggtgcgccacgccgatgatccgctgccaatcctctgcgaaggcctgtggcacggacggattctgaccgctgccagcggcgagcacggtttcggttatgacccgctgttctgggtgccggagcgcgacgtgtccagcgctgaactgagcccggccgacaagaaccagatcagccaccgcgcccgagcaatggatctgctgcgccagcgtctgggcttgaaatgacccgtgcctcttctgcgtcgtcgctgattgtcggcggcgcggcttcttcgcctcgggcgccgctgccgacgctgccgcccttggcgctgtacatccacatcccgtggtgtgtgcgcaaatgcccgtattgcgatttcaactcgcacaccgcaagcccggtgttgccggagcaggaatacgtcgacgccttgctggccgatctcgatcaggatctgcacgctgtttacggccgcgaaatcagctcgatcttctttggtggcggcacgccgagcctgttcagcgccgaagcccttgggcgtttactcgaaggcgtcgagcagcgcattccgtttgccggtgacatcgaaatcaccctggaagccaatccgggcaccttcgagcaggagaagttcgtcgcgtaccgcaagctggggatcaatcgcctgtcgatcggtatccagagcttccagcaggaaaaactcaaggcgctggggcggattcacaacggtgacgaagcggtacgtgcggccggcatggcgcgtcaggccgggttcgataacttcaacctcgacttgatgcacggtttgcccgatcaatcgctggacgatgccttgagcgatctgcgtcaggccatcgcgctgaatccgacgcacatctcctggtatcagctgacactggaaccgaacaccgtgttctggaaccagccgccagtgctgccggaggacgatacgctgtgggacattcaggaagccgggcaggcgctgctggccgagcacggttacgcgcaatacgaagtgtcggcttatgccctggccgggcgcccggcgcggcataacctcaattactggagttttggcgacttcatcggcattggcgccggtgcgcatggcaagctgagccatccggacggacgcatcgtgcgtacctggaagacccgtttgccaaaggactacctgaatccggcgaaaagctttcaggctggcgaaaaagcgctgagcaatgacgagatgccgttcgagtttctgatgaacgctttgcgcctgaccgcaggcgtcgaatcgcgcctgtatccgcagcgcactggcctgtcactggaaagcctcgccgaaggccgggcagcggcagaacaaagcggtctgttgcaggtcgaaccgtcacgtctggcggccaccgagcgcggccagctgttcctcaacgatttgctgcaacaatttctgaactgatttcagtgctaagggaaaacgcatggatttgatactcgacctgctcgccaccgtctcccgctggagccgcagcaacctctcggaaatcgctctggcgctggtcggctgcctgctggtgctgttcggcgctgacttcaaaggctgggtcgagcaacgtctgggcagcatcgccggcgccttgcgcgtaccgctgatgtcgctgctgtgcgtgatcggcagcggcgcggcgctgatctatgccacgccttgggtggtcaagggtttgagccagttcaacaactacagcctggcgccggtgctgctggtggtactggtgctgatcggggtggttgctgatcgccgctgacttgccagccgattgggcgttcctacgcttcgcgtgggaacgatcagatcaaaagatcgcagcgtgccgcagctcctacagcgcgtggttcttccttttttactgttagtcagggacgttcatgagtaaaaaaacgctggacgaaacaagcaagtttctcagcttcgtgttgcgtcacgagcctcaagcgattggtcttacgctggattcggatggctgggcagatatcgacgcactgattaatggcgctgcgcgtgacggtcgtaacctcgatcgcgatttgattgaaacggtggtggcaagtagcgacaaaaagcgttttgccatttctactgacggcttgtgcatccgcgctgttcagggccactcgacgaagactgtcgagttgcagttcgacgagaaacccccaccgcaaacgctgtatcacggcaccgcgacgcgttttctcgattcgatcaatgaacaaggtttgatccctggatcacgccatcacgtgcatctttcggaagagatcgccactgccacttccgtaggtcaacgctacggcagcgtagtggtgctcgcagtcgccacgcagcagatgctggaagaaggcttcaagttctatcaggccgaaaatggcgtctggttgacagagcaggtgcccgctcgatttcttgcgcccttgtaatctcctaatacacaaacaactgtgagagcgaacctgctcgcgaaggcgtcttaacatccaacaacatcgttgattgtcagaccgctttcgcgagcaggctcgctcccactattgggccttggttcaatgactcttcgataagcggctctgcgcctgaaggatcgccttgaggccaacggaatccttgcagcccagcgctatcgctttatcgaagtgttcgatattgccgctgtcgcgcatatcgctgccgttcacacgagtcaacgcgagtatgtagtaggcctcagcccgaaactggtcttcggacaataccaagccagctgcgcgggctcgcatggcggccatcggcccgaccttgccggcaggcgccccgtgttcttcgaaacacagcgaacgtttggcctgcaacggatagtcgtcagcatgcgtatcaggcttgagcagcaactgctcgagagactgcaagaatttcaaatgatcaggattttgcgcatcaaatcgttcatacgctttgtcgcacaaatggtaatagcccaccgcagccgctaacaatccatcatccatggcccgctgataaagaccacaggtctgtaagcgcgtatgctcggaaaacatcgggttgtcctgcagactggccagaacataggtggccagcgtgtgcccgccatccgacgcatgcttgaggttgtccacaagagcctcgagatcaccttcggcaacgcgcaactgttcaggggtgtattgcacgctttccccggcggcctcacgcttgatccggtcattggcgtcgcgctcgatctttgccgccgttctctgcgcactcgcgaagtattcctcggggctgactacccgttcgcacgctgcgcaacaaatgagacccagaaccagcgtgcaggcaaaaatggctttcaagatttgtcgtcctttacaaatgggggcctcgagctttcggcggatcatagccaaacttgagcaaactccagaaacaactgtaggagctgcggcacgctgcgatcttttgatcttgaaaaccaggatcaaaaaatcgcagcgtgccgcagctcctacagggggggggtattgcctaggactcaggactgtttttcgaacttcaggtcccacacgccatggccaagacgttcgccgcggcgttcgaacttggtgatcgggcgttcggccgggcgcggtacgcacttgccgtcttcggcgaggttgcggtagcccggggcgacgttcatcacttccagcatgtattcggcgtacggttcccagtcggtggccatgtgcagaatgccgccgaccttcaacttgctgcgcaccagttcagcgaacgaggcctgaacgatacgacgcttgtggtgacggctcttgtgccacgggtccgggaaaaacagcatcaggcgatcgaggctgttgtcggcgatgcagcggttgagcacttcgatcgcgtcgcaatcgtagacccgcaggttggtcaggccctgagtcagcacgccattgagcagcgcgccgacacccggacggtgcacttcaacgccgatgaaatcctgctccggtgccgccgcggccatttccagcagcgagtggcccatgccgaaaccgatctccagcgagcgcggtgccgaacggccgaacacttgatcgtaatccaccggcgcgtcggccagcggcagcacgtacagcggcgcaccctgatccagaccgcgttgctggccttcggtcatgcgcccggcgcgcatcacgaaactcttgatgcggcggtgttggcgctcgtcgccttcttccgtctggataggcgtgtcgttcgattcagtcatcaatggctcttacttgatcagaccatccagcggcgaagaggcgctggcatagagttttttcggcatacggccagcgaggtaggccagacggcctgcaacgatggcgtgtttcatggcttcagccatcatcaccggctgctgggcgtgggcgatggccgagttcatcagcaccgcatcgcaacccagttccatggcgatggtcgcgtcggaggcagtaccgacaccggcatcgaccagcacaggaatcttggcttcttcgaggatgatctgcaggttgtacggattgcagatccctaggccggaaccgatcaggccggccagcggcatcactgcgatgcagccgatttccgcgagttgccgggcgatgatcgggtcatcgctggtgtagaccatcacgtcaaaaccttccttgaccagcgtttcggcggctttgagggtttcgatgacgttcgggaacagggtcttctggtcagccagcacttccagcttcaccaggttgtggccgtcgagcagctcacgggccaggcggcaggtgcgcacggcttcgatggcgtcgtagcaaccggcggtgttcggcaggaaggtgtagcgctccggcgacagcacatcgagcaggttcggctcgccctcgatctggcccaggttggtgcggcgcacggcgaaggtgacgatctcggcacccgaggcttcgatggcctgacgggtttcttccatgtcacggtacttgccggtaccaaccagcaaacgcgactggtaagtacgaccggccagaacaaaaggcttgtcgctacgaacgatgctcatggggaatcctctttaggggtgagggtcttgcagaattctgtgcccgtacgggccgcccggtcagccgccgccgatggcgtgcacgacttcgacgttgtcgccgtcattgagcgtggtgacggcatgctggctgcgcgggacgatatccagattgagttcgactgccactcgacgtccggtcagttccagacgagtgatcagggccgcaacggtctcgccgtcgggcagttcaagggattcaccgttcaactgaatgcgcatgcgcaacgccgccatcatttttaggggcaggcattctagcccgatcatgacctaaaggtcagcaccaagcgtcaagcggttggttgcaagcgccaggcggccagcccgaggcaaacccatccggacagaaatgccaggccaccgaacggggtgatgatgccaagcttgctgataccggtcatggtcagcacgtacaggctgccggagaacagcaggatgccggcggcgaacgacacgccagcccaagcaaccagtcgcccttgtatctgcgtggccaacagcgccacaccgaacagtgccagggtgtgcaccaattgataggtaacgccggtgtggaaaatcgccagatactccggcgtcaggcggtttttcagaccatgggcagcgaatgcgcccaaagcgactccggtgaaaccgaaaaaagcggccagcatcaaaaagccacgcagcatggggaactccagtcagacgcgatcggcagggtctgtataatggcccgctccacgggttcggccaagccatctctatgctgcgtactattttccgtcgtctcacgaaggccctgctctggttcgcgggcggcagcgtattgctggtgctggtgtttcgcttcgtgccgccgccgggcacggcgctgatggtcgagcgcaaggtcgaatcctgggtcgatggcgagccgattgatctgcagcgaacctggaagccgtgggacgagatctccgatgatctcaaggtagcggtgatggctggcgaggatcagaaatttcctgagcactggggttttgacttcaatgcgatccaggcagcgctggcccacaacgaactcggcggttcaattcgcggcgccagcaccttgagccagcaagtgtcgaagaacctgtttctctgggccggtcgcagttatctgcgtaaaggtctggaggcgtggtttaccgcgctgatcgaagtgttctggcccaagcagcggattcttgaggtgtacctgaacagcgtcgagtgggatgacggagtgtttggtgccgaggctgcggcccgccatcactttggcgtgagcgcgaagtcgctgtcacggcaacaggcgagttatctggccgccgttctgccaaacccgcgggtgtggagcgccagccatccgacagcttatgtgtcgcgccgcgccgggtggattcggcagcagatgagtcagttgggtggggatagttatttgcttgggctcaatgattcgcggcgagcaccgtggtctcgataacaccgaggatctaaatgtaggagtgagcctgctcgcgatagcggtacatcagtgacggcaatgctgactgtcacaccgctatcgcgagcaggctcactcctacaatggttttgtgttgaagcagaaatgaaaacgccccgatcatcgctgatcggggcgttttttattgcctgctcgccggttaggcggcgatcgacaacttgagcttgttcatcgcgctcttctcgagctgacggatccgctcggccgacacgttgtacttctgcgccaggtcgtgcagcgtggctttctcttctgccagccagcgctggtagaggatgtcgcggctgcgttcgtccagcacttccagtgcttcgtgcaggttgctgttggagttgtcgctccagtcggcatcttccagttgacgcgccgggtcgtaccggtggtcttccaggtaattggccggcgactggaaagcgctgtcgtcgtcggcttcagcagccgggtcgaaggccatgtcatggccggtcaggcgactttccatctcgcgcacttcccgcggctcgacgccgaggctttccgccacacggtggacttcctcgttgttcagccacgctagacgtttcttctggctgcgcaggttgaagaacagcttgcgctgggccttggtggtcgcgactttcacaatgcgccagttgcgcaggatgaactcgtgaatttccgccttgatccagtgcacggcgaacgacaccagacgcacacccatttccgggttgaagcgcttaacggccttcatcaggccgacgttaccttcctggatcaggtcagcctgagccagaccgtagccggaatagctacgggcaatgtgtacgacaaaacgcaggtgggcgagcaccatctgccgagccgcccccaaatcctgctcatagtagagactctcggccagttcacgctcctgctccggcgtcagcaatggaatgctgttgacggtgtgcacgtaagcttccaggttcgcacccggaaccaacgcatacgcaggttgcaaagaattggtcatacgaaaaaacctcccacttacatactcgtgcctctcggcactgcgaaaaattgaccggaaactcaagtacaagttcccaaaaaaccgcgaggtcaatcacgcgcaaaaaagattctacttcggcgccagctccctgagatggcgtgcgactgcaatccatgcaccgatataacccaacagcaccgcgccaagcaagagcgacagaccgtcggcaactggcactccggccagcgcgaaatcactgccgtacaagccggccagcccaaccaccgcgtcgttcagccagttcaggccgaacgccaatacaccccaggacaacagtcccgcaccgaagccatacaacgcccccatataaaggaagggacgtcgcacatagctgtcagtgccgccgacgagtttaatcacttctatctcggtgcggcggttttcaatatgaagacgaatggtattgcctatcaccaaaagtaatgcagaaaccaaaagcaccgtcaaaccgaagacaaaacgatcgccgagcttgaggatggcggccagacgctcgacccagactagatcaagttgcgcctgttgtaccttgggcagctcggaaagtttttgtcttaatgcttccagggtcggcttgtcgacttcgttcggggttaccagcaccacgcctggcaacgggttctccggcagctcgcgcagggcttcacccagccctgactgctgctggaactcttccagcgcctgatcgcggccgacatattcagcatcagctacaccgggcatgcccttgatctgctcacgcaacgattcgccctgctgcgggctggcgtcgagttgcaggtacagcgagatctgcgccgctcgctgccacgaaccgccgagacgctcgacgttgttgagcaacagcgaaagccccatcggcaggctcaacgccaccgccatcaccatgcacgtgaagaagctgccgatcggctgcttgccgagacgacgcaggctgtcgagcagactggcgcgatggctttcgatccacgcacgaaacagtgtggcgaaatccgggccatcgtcatcgtcgtgctttttcttcttcggcggctgcggatcggcggctttcggggccacgcgctcggaaaccttcggactgcgtgtcgcactcataccccggcctccccgtcgccgatcaatcggccacgttgcagggtgagcatacggtggcgcatgcgcgcgatcagcgccaggtcgtgactggcgatcagcacgctggtgcccagccgattgatatcttcgaacacgcccatgatttctgccgccagacgcgggtcgaggttaccggtcggttcgtccgccaacagcaaggccgggcggtgaacgatggcgcgggcaatgccgacacgctgttgttgaccggtggacagatcgcccggatacagatcggttttatccgacagcgccacgcgctccagcgccgaatcgacacgtttggcgatttcggccttggacagcccgagaatctgcagcggcaaggcgacgttgttgaacacggtgcgatcgaacagtaactggtgattctggaacaccacgccgatctgccggcgcaggaacggaatctgcgcgttgctgatcgtgctcaggtcttgcccggccagcagcagtttgccgctggtcggacgctccatcgccagcaacaggcgcaacaaggtggatttaccggcaccggagtggccggtgacaaacaagaactcgccacggcggactcgaaagctcagctcatgcaagccgacgtgaccgttcgggtagcgtttaccgacctgttcgaaacgaatcatgaacgctcccgctcggcaaacagtgcctggacaaagggttcggcttcaaaggtacgcaagtcgtcgatgccttcaccgacgccgatgtagcggatcggcaagccgaactgcttggccagggcgaaaatcaccccgcccttggcggtaccgtcgagcttggtcagcgccagaccggtcagttcgacggtctggttgaattgcttggcctggttgatggcgttctggccagtacccgcgtcgagcaccagcagcacttcgtgcggcgcgtcggcgtcgagcttgccgatcacccggcgaacctttttcagctcttccatcaggttgtctttggtgtgcagacgaccggcggtgtcggcgatcaatacgtcgatgccacgggccttggccgcctgcacggcgtcgaagatcaccgaagccgagtcggcgccagtgtgctgggcgatcaccggaatcttgttgcgctcaccccagacctgcaactgctcaacagctgcggcgcggaaagtgtcaccggcggcgagcatgactttcttgccttccagttgcagcttcttcgccagtttgccgatggtggtggtcttgccggcgccgttgacgccaaccaccagaatcacgaaaggcttgttctgcgaagcgattttcagcggctgttcgaccggtttgagcatcgcggccagttcggcctgcagggatttgtacagcgcgtcggcgtcggccagctctttacgggcgaccttctgggtcaggcgctggatgatctgcgtagtggcttcgacacccacgtcggcggtgagcagacgggtttcgaggtcatcgagcagatcgtcgtcgatggttttgcggccgagaaacaggctggccatgccctcgccgatgctggcgctggttttcgacaggccttgcttgagacgggcgaagaagccggctttggtttcttcggtgcgcggggcttcgatggaggcttcggcaaccacttcgaccggcacgactggagcggcaactacgggagcaggtgccggtgccggctcgggctgttgcacgactggagcaacaggagcaacaggagcaacaggagcaacaacgaccggagcaacaggctcaggcgcaataatttcaggagcagcttcagccacaacgggcgcaggctcgatgatcggctcaaccactggcgccggcgccacttcaggcacaaacgcagcaggcgcagggatcactggcgtaacgtgcggcgcagcctcttcaaccaacgccaccggctcttccgccacaggcaaggtcagccacggctcgaccgccggggtcaacggcaattctgcagccactggcgcttccggctctggttccggctcaaccggttgcagcaccggttcggcaatcggcagaacgatcggtgccggctcttcttctataaccggagcaggttccggcgcaggcacaggaatcgcgggcggctgttcgacgacgggttcctgcggtttcttacgcagccatccgaacaggcttttcttctcgccagccgcagctggggtcttcttgtcgtcgttggaaccaaacatggaggacggctatctcacggtagcgacgcgccataagggcgccccggcaaataaatattcgatgcagaacagactgtgtttcatccagcttgttcacgcgcaacattttgtcgaggcgccagaggcacctcaaaggtcgattaatacgaaggactggaacggcatcttcggcgaaaacgcagagtttagctgacaaactcaaagcttatgccgggaacccatacaacctatcgaccgatcagtggcttgataggcgtggccgccagtaaaacggatcagtatcctagcaccctctcgcccgccgacgctaagaccaagcgggcagcccaacaggttaaaaaacgaatgaatgctctagcccgccgcgctgcaggcctgctgctcagcacagtctgcctgcccctttcggccctggcggccgacccgcaaccgacccacgaatttaccctcgacaacggcctcaaggtcgtcgtgcgcgaagaccatcgcgcgccagtggtggtctcgcaggtctggtacaaggtcggctccagctacgaaactccgggccagaccggtctgtcccacgcgctcgagcacatgatgttcaagggcagcgagaaagtcggtcccggcgaagcctcgttgatcctgcgtgatctgggcgcagaagagaacgccttcaccagcgacgacttcactgcttattaccaggtgctggcccgcgaccgtctgggcgtggcgtttgaactggaagccgaccgcatggccaatctgcgtctgccggccgacgagttcgccaaggaaatcgaagtcatcaaggaagagcgccgcttgcgcactgatgacaagccgatgtccaaggcctacgaacgttataaagccatggcctaccccgccagcggctaccacacgccgaccatcggctggatggccgacctcgaccgcatgaaggtcgaagagctgcgccactggtatcaatcctggtatgtgccgaacaacgccacactggtggtggtcggcgacgtcaccccggacgaagtcaaaaccctcgcccaacgctatttcggcccgatcgccaagcgcgacgtgccgccggcaaaaaaaccactggaattggctgaaccgggcgaacgccagatcaccctgcatgtgcagacgcaattgcctagcctgatgctcggtttcaacgtaccaagcattgccacggctgaagacaaacgctcggtcaacgccctgcgcctgatctcggcactgctcgacggcggttacagcgggcgcattccgacgcaactggagcgcggcgaagagctggtctccggcggttcgtcgaactacgacgcctacacccgtggcgacagcctgttcaccttgtcggcaaccccgaacacgcagaagaaaaagaccatggcgcaagccgaggccggtctgtggaaactgctcgaacagctgaaaaccaccgcgccgtccgccgaagaactggagcgcgtgcgtgcgcaagtgattgccggtctggtcttcgaacgcgattcgatcaccagccaggccacggcgattggtcaactggaaaccgtcggcctgtcgtggaaactgatggacaccgaactcgccgatctggaaagcgtgaccccgcaagacatccagaacgccgccaagctgtatttcacccgcgaacgtctcagcgtcgcccacgtcctgccactggagacgactcatgagtgagcgcaaatccccacgcctgatgctgctcggcctgatcgccattgcggtgatcggctcgacggctttctatctgtcgccaagtgctgacagcaaagccagtgaagccctcgacaacgccaagtccagccagaagctgcaatcgctcaccgaactcgacggtaaagccccggccagccgcaagctcgacgtgcagacctggagcaccgccgaaggcgccaaagtgctgttcgtcgaagcccacgaactgccgatgttcgacatgcgcctgatcttcgccgccggcagcagccaggacggcagcgcctcgggcctggcggtgctgaccaatgcgatgctcaacgaaggtgttgctggcaaagacgtcggcgccatcgcgcagggctttgaaggtctcggtgcggatttcggcaacggtgctttcaaggacatggcgctggcctcgctgcgcagcctgagtgctgccgacaagcgtgagcctgctttgaagctgttctcggaagtcatcggcaaaccgaccttccccgccgactccttcgcacgcatcaagaaccagatgctcgccggattcgaataccagaaacagaaccccggcaaactcgccagccttgagctgatgaagcgtctgtacggcgatcacccgtacgcgcattccagcgacggtaatccgcagagcgtgccgaaaatcaccctcgcgcaattgcgtgagttccacgccaaggcctacgcggccggcaacgcggtgatcgcgctggtcggcgatctgtcgcgcgcggaagccgaggcaattgccaatcaggtctcctcggccctgccgaaagggccggcgttggcgaagatcgctcagccgcaggaaccgaaggccagcgttaatcacatcgagtttccgtcgaagcagaccaacctgatgctcgcgcaactcggtatcgaccgtgacgatccggattacgcggcgctgtcgatgggcaaccagatcctcggtggcggcggtttcggcacgcgcctgatgagcgaagtgcgcgagaagcgcggcctgacctatggcgtgtactcggcgttcagcccgatgcaggcccgtggcccgttcatgatcaatctgcagacccgtgcggaaatgagcgaaggcaccctgaaactggtgcaggacgtactcgccgactacctgaaaaccgggccgacgcagaaagaactcgacgacgccaagcgcgaactggccggcagcttcccgctgtcgaccgcaagcaatgccgatatcgtcggccaactcggggcgatgggcttctataatctgccgctgagctacctggacgacttcatgcgtcagtcgcaaagcctgaccgtggaacaagttcgcgacgccctgaacaaacacctgagcacggacaaaatggtcatcgtcaccgcgggtccaaccgtgccgcaaaagccgttaccggccccatctgataaacctgccgagcaaccgctcggggttccggagcattaatggcaactcgttctcctaaaaaacctgcgcacaacgttcacaacggtgtgaaccagttgcgcatcattggcggccaatggcgcagccgcaagctgagcttccccgacgcacctggcctgcgcccgacgccggatcgcgtgcgtgaaaccctgttcaactggctcgcgccgtacgttgaaggggccaaggtgctcgacccgttcgccggcagcggcgcgctgtttctcgaagcgttgtcccgtggcgcggccatgggccaggcgctggatgccagcaacattgccgtctccagcctgaaagaacacctcggcaccctgcgctgcaccaacggtcaggtacagaccgctgacgccctgcgttatctggaaacccagaccgcaacaccgttcgacctggtgttcctcgacccgccgttcaaccagaacctgctgccggccgtgtgcaccttgcttgaagagcgtcagtggctggcgccggattcttggatctacactgaaagcgagacggcaccctcgattctcggcctgccgggcaactggcgcttgcaccgtgagcagaaatccgggcgagtgcactacgccttgtggcaacgtatggcagagatcgccggttaaccgaccggcctgaacaagcggcgcgcttcaccagaggcgccgccgcgctgcatcgagaatcatcgtgccccctccttcagaacgcttcactcccgccctcggcctcggcaatccacacctgcaaaccttgtggggaccgctgtggcgcaaaaccgtgcatatcgaacgcgagcgcgaacgcttgtggcttgaggacggcgacttcctcgacctcgactggcatggcccgcacacggctgacgcgccgctggtgctggtgctgcatgggctgaccggctcttccaactcgccttatgtagcgggtatccagagggccttggccgcgcaaggctgggccagtgtcgcgctgaattggcgcggctgctcgggcgagccgaatctgctgcctcgcagctatcactccggcgccagcgaagacctcgccgaagccatcaaacacctgcgtgcgaaacgacccttggcgccgttgtatgccgtcggttactccttgggcggcaatgtgttgctcaagcatctgggcgaaaccggcagcgccagtggtgtgctcggcgcggtggcggtgtcagtgccgtttcgtctggatcaatgcgccgaccgcatcggccaggggttttccagggtttatcaggcgcacttcatgcgcgagatggtcgcgtacatcaaaaacaagcaacggcagtttcagcatgatggtcgcgaggatggcctggcggcgttggcagcgctcggctcactggagaacatgcgcacgttctgggatttcgatggccgcgtgaccgcgccgctgcacggttttaacgatgccgaggattactaccggcgtgcgtcgagccgctatttcctcggcgagatccgcacgccgaccctgatcattcaggcggcggacgatccgttcgtgttcccgcacagcttgcctgcggaaaacgaactgtcggcgtcgaccgcctttgaattgcaggcacgcggcggacacgttggattcgtcgacggctcagtgcgccagccaggctactacctcgaacgccgtatcccgcaatggctggccagcgtgcccgcatgagcgatcagggcgaatcgatccgattctggcaatcggcgccgctgcccggcgtcgaactgttgtcggcgcgctatatcgaacagcgcttcgccccgcatgtgcatgacggttttgtgatcggcatgatcatggccggcgctcagcgttatcgctaccgcggcgccgagcatctggcggacagcgggacgctggtgctgatcaacccggacgagttgcacaccgggcacaagggcaccgacgacggttggctgtatcgagccttctacccggataccggcaagattgtttcgctgctggatgaacttgaactgtccacgacaagtttgccggcattcggcgccacgctgtatcgcgaccccgatctggtcagcggatttgcacaattgcaccggttgctcgaaagccctgccaccgcgctgcaacagcaaacggtgtggcgcgagatgatgttgttgctgttgcagcgccacgcggcggtgcgagaaatcggtaaccccggcaaggagcaccgcgcggtgctgatcgccaaggatctgctgcacacgcacttggcagcgccgccgtcgctggaggagctggccgcagcggtcaacctgtcaccgttccatttcgcccgggtgttccgccgcgcgactggtatgccgccacacacttggttggtgcagcaacgcatcgctaaggcgcgggcactgttgcagagtggttgcttgccgctggaagtcgcgacgcagttggggtttgccgatcaaagccacttgagccgacagttcaagcaggcttacggcgtcgggcccgcggcgtatcgcagcgcccggatggaaagctaaaagatcgcagccttcggcagctcctacagggaaatgcattccaatgtaggagctgccgaaggctgcgatcttttgatcttattcgccggtggcgatgccgcgagccggttcgttgatccattcgctccacgatccggcatacaacgaagccaacggataacccgccaggcacaacgcaaacaggttgtgacaggccgtcaccccagagccgcaatacgcaaccagatccgctggcgaacgttcgccgatcttcgcggcgaaacgctgcttgagctgatcggctggcaggaatcgtccatcactggcgaggttgtcagtgaacgccgcgcattgtgcacccggaatatgcccggccaccggatcgatcggttcaacttcacccttgaagcgcggcaaggcccgagcatcgatcaacgtcagcgccggctgcccgaggcgcttttgcaatttctcggcgctgatcaacaagctcatgtccggctgaccactgaagttgccacggctcaccgtcggcgcatccaggctcagcggcaaacccgccgcgtgccaagccttgagtccaccatcgagaatgaacacgccgtcacgtttgcccagccacgccagcaaccaccaggcccgcgccgcgtaggcaccgggtccgtcgtcatacagaaccacgtcgctgtcgttgtcgattccccaagcctgtaaacgctcgatcaacgccgccggctcgggcagcggatgccgcccggtcacgcccttgaccactgtgccgctgagatcgcgctcgagatcggcgaagctcgcaccggcaatgtgcccttcggcatagctgcgttgcccgtaatccgggtcttcgagggcgaaacgacaatcgagaatcaccagccccggctgttccttgcgggcatccagcgtttgcgggctgatcagttgcgcaatcggcataacgggctcctgtggagtttcaacagaacggtttatttcacgtcttcgagggcctgggccagcggtacgtaaaactcatcaaacaatgcgttgacctgttcacgcgcctcgtcagtgacgaacccggcttcgaggaccaatacctgatacacgccacgtttaacagcttgctcgctgaggtggttggagttttcacgggtggtgcacagaaagcgcacccatgacgtcaggatgatccacgcgttgagggtcagggattcgatctgcacgcgatccatcttgaggattccggcggcgacaaagccttcgtagatggcggcgccttgaatcacgcagcgctgggaaaagcgccggtaacgcgcagccagttccggatcgctgtcgagcaaatgttcaaggtcacggtgcagaaagcggtaaccccacatcgccgacagcagctccttgagatagaaacgcttgtcttcaaccgtcgcggcacgcccctgcggcgggcgcagaaagctatccaccaaggcttcgtactcactgaacagcacggcgatgatcgcctgcttgttggggaagtggtagtacaggttgcccggagaaatctccatatgggcggcaatgtggttggtgctgatgctgcgctcgccctgctgattgaacagctcgaggctgttctgcacgatgcgctcgctggtttttattcgtggggccatggcttgagctttaattcagagtgcgatgaggggcatcttacgacctatccggaaatggataaaacaaagctgcgcacggaagtcatttgactttatagagcatagactctaaaaagttcaccactacaataaatccggagcctacgatgactgccgacattgcctacctgcaaacgctgcaacagccactggaggagctcaatcggctgttcaatgcgcaacgggcagcgtatgccgccaacccgatgccgcctgccgcccaacgccagcaatggttgaaggcactgcgcgatttgttgagcagtgaacgtcaggcgttgatcgaagccatcagcgcggatttcagcaaccgcagcgccgatgaaaccttgctcgccgaattgatgcccagcctgcacggcattcattacgccagtcgccacctcaagggctggatgaaaccctcgcggcgcaaggtcggcatggcgttccagcctgctgcggcgaaagtgatttaccagccgctgggcgtcgtcggcgtcattgtgccgtggaattacccgctgtatctggccatcgggccgttggtcggcgcacttgcggcgggcaatcgagtgatgctcaaactcagcgaatcgaccccggccaccgggctgttgctcaaggaattgctggcgcgcatcttccccgaagatctggtgggcgtggttctcggcgaggccgacgtgggcgtagcgttctcccgcctgccgtttgatcacctgctgttcacgggttccaccagtgtcggcaagcacgtcatgcgcgccgcggccgaaaacctcacgcccgtgacgctcgaactgggcggcaaatcccccgccattgtctccagagacgtgccgctgaaggacgctgccgaacgcatcgccttcggtaaaaccctgaacgccgggcaaacctgcgtcgcccccgattacgtgctggtgccggaagaccgtgtcggcggcttcgtcgaagcctatcgtcaggcggtgcaaggtttttatccgagcctcagcgacaacccggactacaccgcgatcatcaatgaccgccaactgacccgcctcaatggttatgtcagcgatgccaccagcaagggcgcgctgctgattccgctgttcgagcaggctcagggccgacgcatgccgcacagtctgctgctgaatgtcagcgacgacatgaccgtgatgcaggacgagatcttcggcccgctgctgccgatcgtgccgtatcgcgatctggagcaggcatttgcctacatcaatcagcggccacgtcctctggctctttactatttcggctacgacaaaggtgagcagacccgcgtgctgcacgaaacccattccggtggggtgtgcctgaacgacacgctgctgcacgtggcgcaggacgacatgccgttcggcggcatcggcccctccggcatgggccattaccacggtcacgaaggttttctgaccttcagcaaggccaaaggcgtgttggtgaaacagcgcttcaacgcggccaggctgatttatccgccgtacgggacgtcgatccagaaactgatccagaagctgttcattcgctaaacatttgtcattgccgggtaataacaataatgcacccaagcctgaccgaaacacctgcgctgtcgcgccgtggcctgctgaaattcagcctcggcgccacggcgttcctcgccactgctggcctcggcgccagcctcagcggttgttcttccaacgtcgcagccaacggcttcatcaccttgcgcgacggcgatctgctgtttttgcgcgcactgataccagtgatgctcgaaggcgccgtggccactgaaaagatgccgaacgcgattgaaggcacgttgaagtcgctggattacagcctcaatcatctgtcgccggaaatgctcaaactcactcgccaactgttcgacgtgctcggcatggccgtgacgcgcgggccgctcaccgggatctggggcagttgggaaaacgccagccctgaggcgatgcggcattttcttgatcgttgggagaacagctcactgagactgttgcgcatgggacatagctcgttgcagcagatggtgatgatggcctggtacacccgcgccgaatcctgggggcattgcggttaccccgggccgcctaccgtctgaaaccgcgtcgctcccttcgcgagcaagcccgctcccacattgaaatgcattcccctgtaggagcgagcctgctcgcgatgaggcccgccagaacaacaaaaacaagagaacctgatcgatgcccgtacccgacccattccgcgaaggcctcgcccgaggctggaaaacctacaacggcgcacaactgagcgacgacctgagcctggaagtcgacgtagcaatcatcggcagcggtgccggtggcggcaccaccgcagaaatcctcagcgccgccggctacaaggttctgctgatcgaagaaggcccgctgaagaccagctctgacttcaagatgctcgaagatcaggcctacagcagcctctatcaggaaggcatcgggcgcatgagcaaggacggcgcgatcaccatcctgcagggccgcgcggtcggcggcacgacgctgatcaactggacatcaagctttcgcaccccggagccgaccctcgatcactgggccaaagaacacaacgtcaaaggccacagcccggaggaaatggcaccgtggttcgagaaaatggagcaacgcctcggcgtcgcaccgtggatggtgccgcccaatgccaacaacgatgtgatccgcaaaggctgcgagcagctcggctacagctggcacgtgatcccgcgtaacgtgcgcggctgctggaacctcggctattgcggtatgggctgcccgaccaacgccaaacaatcgatgatggtcaccaccattcccgcgaccctggaaaaaggtggcgagctgctctatctggcccgcgcagaaaaactgctgatcagcgacgacaaggtcacaggtctgcaatgcgtggcgatggatgaacgctgcgtcgaaccgaccgggcgcaccatcaccgtcaaggcacggcattacgtgctcgcgggcggcggcatcaacagtccggcactgctgctgcgctccgacgcaccggatccgcataaaaaccttggcaagcgcacctttctgcacccggtgaacatgtccgccgcgcgcttcgacgaagtggtcaatccgttttacggcgcgccgcaatcaatctattccgaccacttccaatggaaggacggcaccaccggaccgatggcattcaaactcgaagtaccgccattgcatcccgcgctggcggcgacgctgctcggcggttttggccaggagagcgcgcaacacatggctgatctgccgcacacccacgccatgctcgcgctgttgcgtgacggctttcacccggacagcagtggcggcgcggtggagttgcgcggcgatggctcaccggtgctcgactaccaggtttcgccgtacgcttgggagggtttgcgcaaagccttccacgtcatggccgaaatccagttcgccggtggcgcgaaatcagtgatgccgatgcacgccgacgcgcgttacgtgaacaccttggccgaagcccgcacgctgatcgatggcctgagccttgagttgtaccgcacacgcctgggcagcgcccacgtcatgggcggctgcgcgatgggcgaagacccgaaaagcgcggtcaccgacagtctcggtcgtcatcatcaactggccaatctgtcgatccacgacggctcgttgttccccaccagcatcggcgccaacccgcagttgtcggtgtacggcctgaccgcgcaactggcgagtgcactggccgatcggctgaaaaacccgtgaatatccggattattgccatcgtctatagtgctttcttacccaacaggcgacttggccgaccgggacggctgcgataccatccgactccccaacggactcccgccaggacgacgcgatgaaccgagtgttgtacccaggtaccttcgaccctattaccaagggccatggcgatctggtcgaacgcgcctcgcgcctgttcgatcacgtgatcattgcggtcgctgccagcccgaaaaagaacccgctgttcccgctggaacaacgggttgaactggctcgcgaggtcaccaaacacctgccgaacgtggaagtggtcggtttctcgacgctgctcgcgcatttcgccaaagagcagaacgccaacgtgttcctgcgcggtttgcgcgcggtgtcggacttcgaatacgagtttcagctggccaacatgaatcgccagttggctccggatgtggagagcctgtttctcaccccgtccgaacgttattcgttcatttcttcgacactggtgcgggaaattgccgcattgggcggcgatatcagcaaattcgtccaccccgccgtggccgatgccctgaccctacgcttcaagaagtaggagctgccgcaggctcgggctgcgatcagacgatctttggctttttgatcgcagccttcggtgcccttgatcgcgcccgcgtgcactgcgctcgccaatgcggcacaattgcgcgcattgatttatagcgcccgggcctgtcgccccggctggagttagcatgtccctgatcatcaccgacgattgcatcaactgcgacgtctgcgaacccgagtgcccgaacgccgccatctcccaaggcgaagagatctacgtgatcgacccgaacctgtgcacccagtgcgtcggccactacgacgaaccgcaatgccaacaggtttgcccggtggattgcattccgctggacgaggcgcatccggagactgaagaacagttgatggacaagtaccgcaagattaccggcaaggcctgatttttcagcgcctgtaccgacgccatcgcgagcacgctcactcctacattggaacgcatttcaactgtaggagtgagcgtgctcgcgatgaggccatcagccacacagcaaaaccctgatcagctcactcgcgctgctcaaacccctccccgatacaccccaggcaacgcacaaaagcggctttcgccggattcaccaccagcgcctgccccgcatcgcccaccccgccacccagcgcggtaaacggcaacgacacgacaaacgcccccgcaccgatcaccgtcgccaccaccaataaaggtcgggcaatcagcaagtcgccgatcatcgcgtaggccggtggattctggatggtgtaacgcggatcgccgctgccgttttccgtggcctgaacagccagactggaacacagcagcagcgtaacaacgaggacttgcaaggacttcatggcacgatccttcgggctgaacagtgagacaactcactatagaccgtaggactttttcagccgtttgcctcagctctggcagcgcgggcagaacacactggcccgctgacccagcttcacttcacgcagcccggtgccacagaccttgcagtgttcgccgccacggccataaacaaacagctcctgctggaaatagcccggctggccgtcgccaccgatgaaatcacgcagcgtggtgccgccacgctcgatggcggcggcaagaatacgtttgatctcgatcgccagcttcagataccgcccccgggaaatgcctccggcctcgcggcgcggatcaatcccggcagcaaacagcgcttcggtcgcatagatattgccgacacccacgaccaccgcgttgtccatgatgaacggcttgaccgccatggaccgcccccgcgacagctgaaacagacgttcaccatcgaacagatcggtcaacggctccgggccaaggcgaatcagcagttcatgattgagtggatcattgctccacaacatcgcgccgaaacgtcgcgggtcggtgtagcgcagcgccagccccgattccagctcgatgtcgacgtgctcatgcttcaacgccggcaacccgacttcgaccagacgcaaattgcccgacatgcccaaatggctgatcaacgtgccgacttcggcgttgatcaacaaatacttggcgcggcgctcaaccagcacgatgcgctgccccgacaagcgcacatcgaggtcgtccgggatcggccagcgcaggcgccggtcacgcacgatcacccggctgacacgctggccttccaggtgcggggcaatcccccggcgggtggtttcgacttccggcaattcaggcatggtgttctcgaatcaatgcgcgccgaggtcgcggatcgtttgtttgagggtttcgaagtcgtaatccgacagtcctacatagtcgagtaccagcggcccgacggcgttccattcgaaatcttcggtctggttgcccaatacccgatacgaagcgcaaatgtgttcggccattttcaggatcgccaacaggtttttcatctggctgttgcgcgacgactcatcgttgaagatcgccaaggcattgtggtgattggcgatggcagcgctgacatgttccggcaggcgccaggacttggcggtgtagtagccaaccaccgcgtggttggtgttgaactcgctgttctcggtgtcgaccacccgacattcggcgctggcattggcgtaagccttttccagaaccgtcatgtaattggggaaccgctgcagcatcaacggcacgccgcaatcgtggaacaggcccaaggcataggcttcgtccccggcctgggtaccgatgcgcttggccagcgtgaggcaagtcatcgccacgtcctgggcggtgtcccagaaacggttgagcgtgacgatggtgtcgtcattcatctcgcccttgatcgactgcgcgttgatcagattgatgatcgaacggctgcccaagaggtttaccgcacgctgaatcgaggtgatcttgttgctcaagccgtaatacggcgagttgacgattttcagcagcgagccggacaggccgggatcctgagcgatcagcttggcgatcacctccaggtccgggtcgggcatgtactgctccatttgcagatccaccatgatctgcggttgcgccggcacactgatgccttgcagcgattgttgaatctgttcggtggtcagctcttgggacataagtacacactctgggacaggcggcgattctaacccctgaaaccgcagggcgacacaccgatgggcatatcggcggaactttcattcaagctcaggcttcggattttgtagggcacaacgggcaatttctgttcgctgtgccagcaaattcccgcagactcaggagcttatcgatgaccacctcactcaacggcaagcgcgtcgcttttttggtaaccgatggtttcgaacaggttgaattgacaggtcccaagcaagcgctggagcaggctggcgcgcaggtcgacatcctttccgcagaaaccggcaaggtcaaaggctggaaccacgacaaaccggcggacgattttcaggtagaccagacgttccagggcgccagcagcgagcagtacgacgcgatcgtcctgccgggcggcgtgcagaactccgacactatccgcatcgatcaggacgcccagcacctggtcaagaccggcgcctctgccggcaaaccgatcgcagtgatctgccatggcggctggttgctgatctcggcaggactggtcaacggcaagaccatgaccagttacaagacggtgaaggatgacttggtcaacgctggcgcgcactgggtcgataaagaggtggtcaaggatggcaacctgatcagcagtcggcagccggatgatattccggcgttcaacaaagagctgatcgacgcactgtcggcgtagcattggggaccgctttcgcgagcaggctcgctctcacaaaggtcttgtgaccgacacaagaccaatgtgagagcgagcctgctcgcgaagaggcgatcagcgtttcatcgctcatcaaacccggcacaagtcgcaacacgctatactcccgctcttttttccggagcgacgtcatgtccctgccaagcctgcgcctcaaagccaatgccgaccgtcgcctgcgcaacggccacctgtgggtctacagcaacgaaatcgatgtggccgccacaccattgcacggcttcaaggccggcgatcaggcgatcctcgaagccgccggcggcaagaccttgggcatcgttgcgatgagcccgaacaacctgatctgcgcccgtctggtgtcccgcgacatcaaggtgcaactggacaagtcgctgctggtgcaccgtttgaacgttgccctgtcgctgcgcgatcgcttgttcgacaagccgttctaccgcctggtctacggtgactccgatctgctgccgggtctggtggtagaccgtttcggcgacatcctcgtagtccagatcgcctcggcgaccatggaagcgcataaagatgacgtgatcgcagcactgacccaagtgctcaagccaagcggcatcctgttcaagaacgactccgccgcgcgtgatgccgaaggcctcaaccgctacgtcgaaaccgtgttcggcctggtaccagagtgggttgcgctggaagagaacggcgtgaagttcgaggccccggtcatccagggtcagaaaaccggctggttctacgaccaccgcatgaaccgtgcacgcctggcgccttatgccaagggtaagcgcgtcctcgacctctatagctatatcggtggctggggcgtgcaggctgcggcgttcggtgccagcgaagtgttctgcgtcgacgcttcggccttcgccctcgacggcgtcgaacgtaatgctgcgctgaacggcttcgccgacaagatgacctgcatcgaaggcgacgtcttcgaagccttgaaagagctgaaagccagcgaagagcgcttcgacgtaatcgttgccgacccaccagcgttcatcaaacgcaagaaggacatgaaaaacggcgaaggcgcctaccgtcgcctgaacgagcaagccatgcgcctgctcaacaaggacggcattctggtcagcgcttcgtgctcgatgcacctgccggaagacgatctgcagaacattctgctgaccagcgcccgtcacctggatcgcaacatccagatgctcgagcgtggcggtcagggcccggatcatccggtgcacccggccatcgccgaaacccgctatatcaaaagcatcacttgccggctgctgcctaacagctgattggcaaatcgacggggagccttacggctccccgtttgcgtttacacgcacgcccccctgccttttttaacgtccagccttttacttcccacaccggacttccgtttggcgtgcaggaaatttccttgcatcttttaactatctaactttatcccacaagttctttccaacctaaagatgcatccgacaaaattactggaattttcctacttaatatccgcttgccattaatccattacaaactattattgagttgtcaccacgaggtggcacttaccaaaaattgaacaaggagttcacgttatgaaagttatctctatggaaggcaacaaaatcgcaaacctggcttttctcgtagcgcctaaagcccgctaagcaagtctagacgccggagagtgccggcactccggcgtctttcagacttccaaccagagaagccccaacatgcatatcaatccatacttgttcatcctgccgcgcacaccaactcaagtagtctggaattataaagaccatgttcagcacgaactggatttcgactattcgtcacgcctgacacaattaatcagcaatcccgaactattcaatagtcgaaacaccatagacatacaactattgaatgccgggatattaaccatttcagaaaccgacaatacggaatggggttgggatgagttgtcgaaaatctatcacatcggcacacagaacattccatgcaaacatattccgcaaaatattcatgagtggagcagagaatatctggaccactgcaacgaagtattggctgaccctgcgcctcaagcaggacgtgtgctcaaaaactccagcgcacgcattgcgctgcccaccccgaccacacccggtcacgacaacctgacccacgtcctgactcagcgaaaaacctgtcgctccttcacgggagccgccatttccctcagcgacgtcagctcattgctgtacctgtccttcggctacctgcgcgaacgcgacagttctgcagacggcattgctgaaggcctcgacgcgcgacgcagcagcccatccgggggcggcttgaatgcctgtgagtgttttttgctggcacagaacattgagggcctggacgccggcgtgtatgcctaccacccagccgaacatgtccttacccccgtgagcccatcgccgcaatgcgcgctcggccaactactcggcgggcagcacttcatcaacaacctgccgctgggcctgttcatcaccgctcgcttcgacaggttatggtggaaataccaacactcgcgcgcctatcgcatggccttcatcgaggccggtcatctctcgcaaaccttccagctggtcgccacggcgctgggcctcaatacctggctgaccggcgcgttcgccgacgatcaggtcgagtccttgctcaagatcgaaggcagcgccgaacaaccgctgttctttgtcggctgcggtgaaagcgatggtcaggcgatgtgtcaggaaatgctcgatctgttgcacgaggaacaggcatgaacgcgtcccttgtcgaacaggaagaggctccggcttcctgggcgctgcgctttaccctcggcgactgggacactcgcgcttcagtgcgcaccagtcagcacgaccatcaattacccgatgacgtgcagcagcagttgctgagccgtcactggtttcctccggcctttctgccgtatctggcccacccggccatcgtcgccgcaggtcgtgacgtcacccatcgcctgacagccaatcatctggtgcattttctcgactacacaacactgctcgagcaccgcatcgtcaaccgcgctgtcgaggttattgtccacggcgagctgcctgccttcgtgccagaacgcatgaaaaccgccgcgctccagctctataccgacgagggctaccatgccctgttctccaaccgtctcgcagaacatatcgccagtctgtacggcttcacccaacgcccgcagatgccactgcgcatcagccggctgaatgccctgatcgcccgcactcccgaaaacaaccgcacgctggcctggtttctgcttggcttcgtttcggaaaccatcattgcccgcgagttgctggacgtctgccgcgatagcctggtgtccagcgtcaatgacatgttgcgtgatcaccttgcagacgaagcccgccatagccgctacttcactgaggtgttccattacctgtggctgacgctgaacactcgtcagcgcagctttgcggccagaaccctgctgaacgtgatcgatattttctttgaggtcgacgagcgttggttgcaacagagcctgcgcagcaacggcatcgccgaaccagccatcgatgaaatcctcgtcagcctgacccacgcgcaagccaaacgtctgcgcaccaggacgggagccatcgccaccctcgacgcactgaaaaaggccggttttttcgcattgcccaacaaccgagaactcttttccaaggcgggactgctcgatgagtgaaggaaaacctgcggtcactgcccagcaacgacgcggcgctgtcagcctgttattggcgatggttctgctcggcgtgtttccgctggatgtcctgctgccgtcgttcccggccatggccgagcactttcgcagcagcccggcggatatagcactgtcgatcagcctgttcgccgtcggcattgcctttgcgcaattgctgatcgggcccctgtcggacgtgatcggacgcaaagggctgcttctcgccggcatggcggtgtcgatgctcggcgcgcttggttgcacgctgtccagcgattactcgctgttcctgttctttcgtctggtgcaggccctgggctgcggctgcttcgtgctgtcccaggcgctcgtgcaggacctgttcgaaggcgaggaacgtgatcgcctgcgcatcctgatggtcacggcgacgggaattttcatttcagtatcgccattggccggcaccttcctgcaggccagcctcggctggcgtggcagtttctgggtatttgccgcactggcggcagctgtgctgatcaaggcgtggcgctttctggacagcgggcggccggtcgccagcggcagccccgtccagttcttcaacgcttaccgacgggtgctgggggaccgcgatttcgttggcctgtggctgatttcggccttcgcgttcgcctgccacttttccttcatcgtgatttcaccgctgatcttcatgaatcaattgcagctgtcgccctacgacttctcaatgatcctgctgatatacggtgcggcttacgtggtcggcggcattgtcgccaccgtgctcagccggcggatcacgcccggccagcagatcgttaccggactgagcctgatcctgctgtcgggactgatcatgctgacgctgtcgaccaatgtcgaactgtccgccatcaccgtgctgatcccgatgttgatctgcaccgctggcaccaccatcgcgcgcccggcagccacatcccgggccatgggcctgtttgcggacatggcaggcacatcggcctcggcgggcagcacgatcatcttcatctgtggaggcttgatcagcgcactcatcagcctgagccctgccaatctccagtcgatgctcggctactgctttgtgctgctcagcggcgtggcgctggtactgaacagccgcatcagcgcgcgtgcccgaaacctggaggccgccatcattctgcggccgggggcggattgaacctgccggtcgtcatcccacagacaccgtcggcactgcaacaacactttgcgccattccctccagacgccagcggtgtagaatcggctgattcatcgccattcatcccccggcgggtttatgagctcaggctgagaccagcggcgatcccgcaacgtcatcggcaacttccggacacacggccatttctgagtgttccagaggtcaatagaagctcactcccatttagtacctgattagccgcccggagtgctccatgccagattaccgctcgaaaacatccacccacggccgcaacatggccggcgcccgcgcactgtggcgcgccaccgggatgaaagatgacgacttcaaaaagccgatcatcgccattgccaactcgttcacccagttcgtaccgggccatgtgcatctgaaagatctgggccaactggtcgcccgtgaaatcgaacgcgccggcggtgtagcgaaagaattcaacaccatcgccgtggatgacggcatcgccatgggccacgatggcatgctgtattcgctgccgagccgcgagatcatcgccgactccgtcgagtacatggtcaacgcccactgcgccgacgccatcgtctgcatttccaactgcgacaagatcaccccgggtatgttgatggctgccttgcgcctgaacattccggtgatcttcgtttccggcggcccgatggaagccggcaagaccaaactcgcgtcccacggcctcgacctcgtcgatgccatggtgatcgccgccgacgaaagcgcttctgacgagaaagtcgccgagtacgagcgcagcgcctgcccgacttgcggttcgtgctccggcatgttcaccgccaactcgatgaactgcctgaccgaagcattgggtctggccttgccgggcaacggttcgaccctcgccacccacagcgatcgcgaacaactgttcctgcaggccggtcgtaccatcgtcgagttgtgcaagcgttactacggcgagaacgacgaatcggtgctgccgcgcaacattgccaacttcaaggcgttcgagaacgcgatgatgctcgacatcgccatgggcggttcgaccaacaccatcctgcacttgctcgctgccgcccaggaagccgaaatcgatttcgacctgcgcgacatcgaccgtctttcgcgcagcgttccacagctgtgcaaagtcgcgccgaacatccagaagtaccacatggaagacgtgcaccgcgctggcggcatcttcagcatcctcggttcgctggcccgtggcggtctgctgcacaccgacctgccgaccgtgcacagccgcagcatggaagaagccatcgccaagtgggacatcacccagaccaccgatgaagcggtgcatcacttcttcaaggccggtcctgccggtatcccgacgcagacggcgttcagccagtcgacccgctgggaaaccctggatgacgaccgtgaaaacggctgcatccgcagcttcgaacatgcctattcgcaggaaggtggtctggccgtgctctacggcaacatcgctgtcgatggctgcgtggtgaaaaccgccggtgtcgacgaatcgatccacgtcttcgaaggcaacgcgaagatcttcgaaagccaggacagcgccgtacgcggcatcctcgctgacgaagtgaaagccggtgacattgtgatcattcgctacgaaggcccgaaaggcggcccgggcatgcaggaaatgctctacccgacctcgtacctgaaatccaaaggcctgggcaaagcctgcgccttgctcaccgacgggcgtttctccggcggtacttcgggtctgtcgatcggccacgcttcgccagaagccgctgccggcggtgcgatcggtctggtgcaagatggcgacaaagtgctgatcgacattccgaaccgctcgatcaacctgttggtcagcgatgaagaaatggcggcacgccgcgccgagcaggacaagaaaggctggaaaccggtcgagattcgtccacgcaaagtgaccaccgccctcaaggcttacgccttgctggcgaccagcgccgacaaaggtgctgtgcgtaacaaagcgatgcttgaagggctgtaagcgtcaaatcgcggcaacaaaaaagccccgccaaagtgcggggctgatcgttcccacgctctgcgtgggaatgtctcaagggacgctccgcgtccagtgacgcggagcgtcacgggctgcattcccacgcagagcgtgggaacgatcaaacgcattccaattgtaggagtgagcctgctcgcgatgggagcgacccggtcttactgaatttcttcaggcttgacgatcacccagttcttgtccgcagtcaccggcaacccttctttcgcctgcgccgccgcgtgcttggccatcatgccgttgatttgcgtcatgtacttgtccttgcggttgatccacaagtgaatcccgcccttggccacgtcgacatcgtggaacagcatgtaaccatcgctggtcggggtatcgccgccaaccagtaccggttttttccattcgtcgatgtaggtgagaatcgccgcgtgcttgccggccatccaggtcgccggggtccacaggtatggggtcagctccagaccgaggttggccttctcgtcatatttaccggcggtgatctgtttgcgcgcggtggtcagttcgccggtcttcggatccttgagcaacatcgaaacgccaatgacgttctgcggtttgacgttgtagccatacttcggatctgccgcgaccatgcgcaccaactcttcagaagcggcagtcatcacgtagacctcgatgccgttctccatcagcttgttgtacagctcttgctggccggtgaagatcttcggcggattgacgtcgagcttcttgaccacatcgccttcgtaataagtcgccggcaccggtttgcccgaagccatcagctcgtcgacgtagcctttgagttctttgagggtgaaaccggaaaacacctgtgccacccacgggtagcagaccatgtcgtcgacttcgcagagacgatagtagtagctgaacaggctctccttgtggtcggcggtgtccttgaacggcatcagtttcagggagggatcgagcttgtcgcgggtaatcaggcccttgttttccatgaacggcagcaaggactcttcgaggtcgtagcggtaactggtgttgtccatgtcgaacaccgcgtagttacccttgttggcattggcggcgatcatcgcgtccagcgccttggcctgatccgccggccagtgtttcaggtcggtggcgaaggcttgagtggccagacccatgcccacagccagtgcgacagccagaaatttcggtgcaaacttcataagcctcttctccctgattcaaagagatcgacgctaacaaatatgtgtgacagtcctcgtctgtcagcgaccgctcacgtccctgtttgcgccagatgcattgccgagagcgacacgcgcttattccaaaaacgacggacgccctgcgatttcggtattaaatcattgcaaatcaaactgttaggcttgccggttcgcagttgcccaagaatgcgactggcacaagtcttatcggagttttcatgaatctgccgctgatcctcaatctgctggtgttcctcgccctgctcttcggtctggcgcaaacccgccacaccacgtggagcctggcgaaaaaagtcctgctcgccctcgcgctgggcgtggccttcggcgtcgcgctgcacaccgtttacggtgccggcaacccggtgctgaaagcctcgatcggctggttcgatctggtcggcaacggctacgtgcagttgctgcaaatgatcgtcatcccgctggtgttcgcctcgatcctcagcgccgtggcacgcctgcacaacgcgtcgtcgctgggcaaaatcagcttcctgaccatcggcaccctgctgttcaccaccgcgattgccgccctgatcggtatcggcctgaccaacctgttcggcctcaccgccgaaggtctggtcgccggcacccaggaaatggcccgtctgcaaaccattcagactgactacgccggcaaggtcgccgacctgaatgtgccgcaactgctgctgtcgttcatcccgcagaacccgttcgccgatctggcgcgggccaagccgacctcgatcatcagcgtggtgattttcgctgcattcctcggggttgccgcgctgcaactgctcaaggatgacgtcgagaaaggtcagaaagtgatcaacgccatcgacaccctgcaagcctgggtaatgcgtctggtacgtctggtgatgaagctgaccccgtacggcgtcttggcgctgatgaccaaagtggtcgccggttccaacctgcaggacatcatcaaactcggcagtttcgtcgtggtctcgtacctcggtctgggcctgatgtttgtcgtacacggtttgctggtgtcggccgccgggatcaatccgctgcgattcttccgcaagatctggccggtgctgacgttcgcgttcaccagccgctccagcgcggcgagcattccgctgagcattgaggcgcagacccgtcgtctggggattccgcaatcggtggcgagttttgccgcctcgttcggtgcgaccatcggccagaacggttgcgccggtctgtacccggcgatgttggcggtgatggttgcgccgaccgtgggcatcaacccgctggatccactgtggatcgcgacgttggtggcgattgtgacgttgagttcggcgggcgtagccggtgttggtggcggcgcgacgttcgcggcgctgatcgtgctgccggcgatgggcttgccagtgtcactggtggcgttgctgatttcggttgagccgctgattgatatgggccgcacggcgttgaacgtgagcggttcgatcacggctggggcgattaccagtcaggtgatgcagcagaccgataaagagttgctggatgctgatgagcatgcggagttggctcaggcttaagtaacgcctgacagaccgctatcgcgagcaggctcactcctacaattggaatgcgttcccccttgtaggagtgagcttgctccgggcggcgttccgacgatgctttttaagccttttcccaaacctcaaagctgtacgcgggtttatcgccttcagccggattcggcacattcgacaccagtttccactggttcaaatcaaactcaggaaaccacgcatccccctccgggctcaacgccacgcgggtcagatacagacgatccgcctgcgccagcccttgcgcgtacaactgcgcaccaccaatcagcatcagctcatcaacgccctgcgccttcgcccactcctcggcgcgaaccacggcagcttccagcgacggatacacctcggcaccttcgagcagcagatcggcctgacggctgaccacgatgttcaaacgccccggcagcggacgaccgagcgaatcccaggtcttgcgccccatgatgatcggcttgccgagcgtcgtggccttgaagtatttgaagtcccccggcaggtgccagggcatgctgttgtcgacgccgatcacgcggttttcaccaagggctgcgatcaggctgagggggagtgatttagtcatgccggcgaggataccagagccgcgcgtacccggataagcgccacagcggttatgctcagcgctcaattgagcgacgggatgccgcgtgactgaactgactccactgcaaaacctctggctcaccgagaccgtgcgcctgcgcgaagaacacgcaggccccttggatgacctggaagccaatcgtctggcgcgtacggccggcggcgatctgccgggccgcattcaacgccgcgcgctttggctggccgagcgtgacgggctgaccaatgccctcagacactggctgcaaggcgcgcgtctggcgctggtgttgctgatgatcttcgcggtattgagcggcgccggtctggccttcgccgcactcggccaaacgccggtcaatgtgttctgggccttgggcagtctgctcgggctgaacctgattctgttgctgagctggctgctgggtttgatctttgccggcgaacacggcgccacgctcggacggttgtggttatggctcagcgagaaaatggctcgcgacgccaaagccgcgcaactggcgcccgccctgctgctgatgctgcaacgcaagaaactcaatcgctgggcgctcggttcgctggtcaacggtttgtggctgctggcgatgttcagcgcattgattctgctgctgacattgatggcgacccggcgctacggctttgtctgggaaaccacgattctcagcgccgacacctttatcaacgtcactcatgccctgggctatctgccgtcgctgctcggtttcaatgtgccgacggtggagatgatccgcgccagcggcgacggcgcgctcgacatcgaaagcgcccgtcaggcctgggcgacatggctggtcggcgtgttggtggtctacggcgtactaccgcgtctgctgctgacgctgttgtgtttctggcgctggaacagcggcaaagccgcgctgcgtctggacttgaacctgcccggctacgcgcagctgcgcgaacgtctgatgccgaccagcgaacgcctcggcgtcaatgatccggagcctgcgcaattgcatcgggttgaaagcagcgttggtgagctggtcagcgaaggcgcgttgctggtcgccatcgaactcgacgaacaacgcccatggccaccggcattgccgaaaaacgtcagcgacgccggcattctcgacagccgcgaatcacgccataaactcctcgaacaactcagtcgctttccgccagcacgtctggcgattgcctgcgatccacggcgctcgccggatcgcggcagcctcgcgctgattgctgaactggcgcgtagcgctggcgaaacccgcgtgtggctgctgcaagcgccgcccggcgaagcactggatgccgaacgcctcggcgactggcacatcgcgctgcaacagcttgatctgaagtttgccgattgcgcgccgctgaactggttggagactggccatgactgaagcctggaaagcgccgctgaaactcgcggtggtcggccacaccaacgtcggcaagacctccctgctgcgcacgctgacccgcgatgtcggcttcggcgaagtctcgcatcgcccgagcaccacgcggcatgtcgaaggcgcgcggttgtcggtagacggcgaaccgttgctcgacctgtacgacacgccgggactggaagacgccatcgccctgctggattttcttgagcgcctggaacgccctggcgaacgtcttgatggcccggcgcgactggcgcggtttctcgacggcagcgaggcgcgccagcgtttcgagcaggaagccaaagtcctgcgacagttgctcgcctcggacgccgggttgtatgtgatcgacgcgcgcgaaccggtgctggctaaatatcgtgatgagctggaagtgctcgccagttgtggcaaaccgctgctgccggtgctgaattttgtcagcagcgccaatcatcgcgagccggattggcgcgaggcactggcgcggctagggctgcatgcgctggtgcgtttcgacagcgtggcgccgcctgaagatggcgagcgccggctgtatgaaagcctcgcgctgctgctggaaaacgcccggccacaactggagcggttgatagccgatcagcaggcgcagcgcctcgcacggcagcaaagttcggcgcgtttgattgctgaattattgatcgactgtgcggcttgccggcgcagtgtggtcagcgaggccgagcgggaacagcaggccatcagcgaactgcgcaaggctgtgcgccagcgcgaacagaagtgtgttgaggcgttgctcaaactctatgcgtttcgcccgcaggatgcggcggcgagtgatttgccgttgctggatgggcgttggggcgatgacctgttcaacccggaaaccttgaagcaactcggtgtgcgcgtgggcggcgggattgctgccggcgcggctgccggggctggcgtggatttgctggttggcgggattactcttggtgcagcggcgttggcgggggcgattgccggtggcgcgctgcagacggcgcgcagttatggcagtcgcttgctgggcaagatcaaagggcagcgtgagctgacggtggatgacggggtgttgcggttgttggcgttgcgtcagcggcagttggtgttggcgctggatcagcgtgggcatgcagcgatggacgcggttcaggtggcgacgccgcaggacaagacctggcgtgagggcaagttgccggaagcgctgaacaaggcgcgggcgcatccgcagtggtcgtcgttgaatccgcaggcgaagttgaatcaggcggagcggcaggagcagattgaggcattggtggggaaggtgcttgagctgtagatcgctaccccctcaccccagccctctcccagagggagagggagccgatctttatgcttttcaaacctgagttcgactggatacctcaggtcgatgtatcacctgagaacaactccgtaggctccctctccctctgggagagggctggggtgagggttgcaatcacccggccgacaataaaacttcagccttgcgcttcagcacacccaaatccatcaccggcaccgcgctctccttggccagctcatcccactgcctcatccgcaagctgaccgcacacaacggatcccgctcaaacacatccgcctccgcctccgtcatcaccccgccctgatactccagcgtccgccgactcgcctcactcaaccgatcaaaataccccggctcacgcaacgtcagataccgcttggcctgcacgtgatattccaccaaccgcgccatgcgctcgctgaagccggcctcacgcaaataatccgcgccgagccgctcatgactgaccacgccataaccgcccatattctccgcgccttcggcacacaaatggccgatgtcgtggaagaacgccgccaacaccacttcatcatcaaaaccctcggccatcgccagttcagcggcctgggacatgtgctcgatctgcgacaccggttcgccgatgtaatcactggtgccaaagcgctcgtacagtccgaagacccgcgcgacgacttgctcgtgagctgtcattcaatttcctccagcaactgcgcaacattgcgctcggccagcgccgggccgacgctcatgccgacaccggtgtgcatcagcgccacactcaaccccgctgccgggcgcagcaacgaaaacggccctggcccccgagaaccatagacgccctgccagcgctcgaccacttgcaccttgcagcccagcgtctgctcggccagttcaagcatccagttatccacttgctcggcgttgaacggtgaagggtcgctgccgtaatggtgcgagtcgccgatgatcagttcgccgtacggcgtcgggctgatcaacaggtggatgccgttgtcgtgcaggtgcggttgttcacgcaggatctgcgcctgcaccgccgctgcttccggcagatcggcgaaggcgccgtagtgcacgcagctcaggccggtgagcaaggcgtgctgcagattcaggtcgatctgcggtttggcgcggagcatttgcaggcggcagatttgcgggtcgagcgcggcgatcggctccgcgagcaaggtctgataatcgtggccggagcagacgatgatctgcttcgcggtgaagctgccgacggtactgtgcaggtgaccgggttcgacgtcgcgcactaatgtcgagaagtgaaactcgacgccgaggtcgcggcgcaggtagtcgatcagcgctgggatcgcttcacgcgaatacagctgttgatcgtcgatgccgtggagggcggcgcggtggtggctgaactggccgttgtagagatcacgcagggcggcgccgcgcagcaggtcgacgttgtagccgtgctcaatggcgcggccggtgcagaaggtgtcgagcaggtgttcttcggcttcggttcttgcgaagagataagagccgttgcgcttgatttgcaggccggcgagttgcgcccagtcgccccaaatctcgcggctggccttggctagctcaagcatttggccgggtggttggccagtgaccagcgcctggccgaagttgcgcaccgaggcgccgagaggggtggcggtgcgttcgaaaacggtgaccttgagaccgcgtttggcggcggcgtaggcgtgggacaggccaaggatgccggcgcctacgatcagcaggtctttgtgttgtgtcatctggattatgtcctgaatgaaagaccgcaatcgcgagcaggctcactcctacagttggaatgcgttcccctgtaggagtgagcctgctcgcgatgaggcccgatcagactacgaagatttatttggccgccactttctcggacttgccgtcataacgcttgcgccactcggtcaggatctcgtcacgattcttcgaggcccaggcaaagtcgttcttgatcaggcgctgctcgtagtcggccggcagttcggtctgcggcttggcgatgcccggttgcgcaagaacagcgaagttctccttgtacagatccatcgcctcagcacttgccgagaagtcagccagtttcttcgcggcctcttcatgcggcgtgcctttgatcacggcggtcgcttcgatctcccagcccagaccttccttcggcagaatgatgtccagcggcgcgccttgacgcttgagctgtaccgctgggtattcaaaggaaatcccgatcggaaactcgcccgccgccgccagtttgcaaggcttggaaccggagtgaacgtactggccgatgttctggtgcagaccgtccatgtaggcccagccctgcttctcgccgaaggtttgcagccaagcgctgacgtcgaggaaaccggtgccggacgacgccgggttgggcatgacgatcttgcccttgtactcaggcttggtcagatcctgccagctcactggcttgctcagaccttgcttctcggcctcgacggtgttgaagcaaatcgttgcggcccagacgtccatgccgacccacgctggcgggttggcggcgtcgcggtagttcgcgccgatcttgccgaggtccttcggcgcgtagctttgcagcatgccttgctgatcgaggatcgccaggctcgaagcagccaggccccacaccgcgtcagcctgcggacgggccttttcggcgagcagtttggcggtgatgatcccggtggaatcacgtacccatttgatctcgacgtccgggttggccttttcgaacgcttccttataggacttcagttgctcggcttcgagggcggtgtacaccgtcaactcggtttttgccgcgaaggcattcaggctgaaagtagcgaacacagcagcggccagggccaaaggcttgaacatgatcggtatcctgtcttttgagttgagggtgtgaatcagtgaccaggcgcggtttgtcgccaggcttgagaacggcgcagcaagccgcgcgaagcccacgccagcagcaaggacacgcccgccgaggtgaacagaatcagggtcgacatcgccgccgcaccgccgacgttgccggcgtcatccatgttcagcaccgcgactgccgcgaggatggtgtcggggctgtagaggaagatcgccgccgacaccgtggtcatcgccgagacgaacaggtagcgcacgatgtcgagcagcgccggcaggcagatcggcacagtgacgcgcaggtaatgccggtacagcggcgccttcagcgacagcgcggcggcttcgaactcgccgtcgagttggcgcagcgcggtggtcgcggtcatttgtgcggtggtcaggtagtgcgcaatggtgcagacgatcagcagcgtcatcgtcccgtacagcacatgcagcgggttacccgtgaggttgaagaagaagacgtagccgagaccgagcaccagccccggcaccgccatcggcacgaaactgagcatgcgcaaggccaggttgaggccacgttggctgcgggttttctccatcagataggtgccggtaaagatcagcacactgccgatcaacgccgtgcccaaggccattttcaaactgttgctgtaagccagccagccaccgccagcggtttcgttgaactggtagtggttgagtgacagcgacaggttgtacggccagaacttcaccagcgaggagaacaccgccataccgaacaccagaatcaacgcggcgctgatcagcaagacaatcgccagatagcagccatcacgcaacttcgacggcgccggtttgaacacctgcgctcgaccgctcatggagtcaccgtgacgccgacgtagccaggcgtcgacgccgaagctgaacagcgccggcagcaacagcaccatgccaatcaatgcgccgcgaccgaactgttgttggccgaccacagctttgtaggcttccagcgccagcacttgatagtcgccaccgaccaccaccggcacaccgaagtcggtgatggtcagggtgaacaccagacagaacgcggcgaacacagcctgacgcgtcgccggccaggtgatgctgcgaaacgccttggccggactggcgcccatgctcgaggcggcatcgaaaagacgggcatcggccagcgacaacgccgagagcaaaatcatcagcgcatgcgggaaggtgtaaatcacctcacccagcacaattccccagaacccatagatgttgtccgagagcagcccgcgcaacatgccttggttgccgaacagataaaccagcgcaatccccggcagcatcgacggcgccatcagcggcagcagggaaatcccgcgccagatgcccttggctggaatcattgtgcgttgcaacgcgtaggcaaacaggtaagccagcggtacgacgatggccgcaacgctgagggaaactttcaagctgttgccgagtagccagtggaaattctcgctggtcaccagttccttcgccgcgacccagccaccgccctgcccggcttcactgctgaagccgcgccagaagatcgccagcagcggcagcaacaccgcgacgccgagcaacaccagcaaaagaactttgccgccgacgacaaaaatgcgatcgccgatctcggctttggaggtctgtcgcacctgcttgtgcggtagcggcagcgcgagattgctgttcatcaggcaaacacctgcaagctgcgcggcggcaaggcgaccatgatttgctgagcgccgaggcgcggcatggcttccggcgcgagttcggcgagcaaggcgtggcccggcagttgatcgagttcgaagctcatgcggcagcggttgccgaggaaggtgatttcgcggactttggccgggaacaggttttcttcgtgcaccggtggattgacgttgatcgcttccgggcggcaaaacaaacggcccgaggcgcgctgaatgctgccatcgctgaggcgcagattcatcccgccgacctgcgcgtggctgtcactgctgcgctggaacggcagccagttgccctgcccgacaaactcggccacgaacggtgtggccgggcggttgtagatttcctgcggggtggcgtactgctcgacgcggccgttgttcatcacggcgatgcgatcagccatgagcatcgcttcgtcctgattgtgcgtgaccatcagggtggtgatgccgaggctgcgttgcagttggcgcagttcggtgcacagatgctcacggacacgggcgtcgagggcggacatcggttcatcgagcaacagcagcgacggtgccggcgccaaggcccgagccagagcaacgcgctgttgctggccgccggacaactggccggggtactttttctcgctgccggtgaggccgaccagttccagcatctgtccgacgcgctggcgcacttcatcgcgaccgctgccagcaaggccgtaggcaatgttcgcctcgacggtcagattggggaacagcgcgtaagactggaacagaatcccgtagtcgcgggcttgcggggcgaggtgcgagacgtcgcggtcaccgaggtacagctcgccgctgtcctgcttctccagaccggcgatgcagcgcagcaaggtggttttgccgcagcccgacgggccgagcaggcacaccagttcaccggcggcgacgtcgagggagacattatccagcgcagtaaacgcgccgaagcgtttctgcacgccgcgcactttcatcggcgcaccggggttggtcagggcagttgcgatggcaggattcatggacagacctcatcaagcagatggggccaatcctagagttgtaatgcgtccgtcatgtggcaacgaggcaaaaacggccgatagtggtattcagggattttggttcaccagagatcgttcccacgctctgcgtgggaatgcctcatcggacgctccgcgttcggctgttgggacgcagagcgtcccgggctgcgttcccacgcggagcgtgggaacgatcattacgcgggggacatttcttgggccaagccgaggaacgccgccggcaaccgcgcgcccttgcgctctttcaggcaatagaggtactcaggaatctgcggcgcattctcgatcgtcagcacgcgcaactgcggatcatgcggcacttcctggcgggcaatgatgctgatgccgatattgcgcaacaccgcctcacgaatcgactcacgactgccaatctccagcaacggaccgaaactcacccccgcagtcgccagcaactcttcggtcaaccgccgtgtagtcgaaccggattcacgcatcaacaacgtgtgcccggccagtgcactcaacgccacatgttcctgtgccgccagcggatgattgcgatgcaccgccagcaccagcggatccgtgcccagcacccggcggatcaaccgcgcgtcatcgagcaattgcgacgacgcggcgatatccacccgatagtcctccaacgcttcgagcacctgctgcgaattaccgatttccaccgacacttccacctgcggcaggcgctcgcgaaaggtcttcaccagatcgaggatgtaataaggcgccgtagcggcgatgcgcaacgtgccctgcacctgaccgctgttgcgcaggaaaaattcgatgtcggcttcctgctgcaacagcgtcttgaccatcggcagcaaccgcgcgccttcgtcgctgacgctcaggcgtcgaccgccacggtagaacagctccaccgaatactgactttccagattgcggatctgcgtggtcacggtcggttggctgaggccgagttttttcgccgccagcgtgatgctgcccaggcgggcgaccatgtaaaacgctttcagctcggcactcagcacaacctttcctcatctatttgcgcagcaggcgcaaaccgttgaacaccaccaacaggctcacgcccatgtcggcaaacaccgccatccacatggtggcgagtccggcgaaggttaccgcaagaaagatagccttgatcaccagcgccagcgcgatgttctgtttcaggatgctggcggtattgcgcgacaggctgatgaacgccgggatcttgcgcagatcatcgtccatcagggcgacatcggcggtttcaatcgcggtatcagtaccggcagcagccatggcaaaaccgatctcggcgcgggccagtgccggcgcgtcgttgatgccgtcgccgaccatgccgacccgccgaccctgtgcataaaggtcttcgatggcttgcagtttgtcggtcggcagcaaatcgccacgtgcctcgtcgatgccgacctgcgcggcaatcgcctgggcggtgtggacgttgtcgccggtgagcatcagggttttcacccccagtgcatgcaactggcggatcgcttcgcggctggtttccttgacggtatcggccacggcgaaaagcgccagcgggccggagctgtcgagcagcagcaccacggatttgccctgtttctccagggcgaagagtttttcttccagtgccggcgagcacaatccgagttcttcgaccagacgatggttgcccaaatggtaagtctggccattgatttcgcctttgacgccacgaccgcccagcgcttcgaagttatccacaatcagcgcggcgaagtttttatccacagcagcgttggcgatggccagcgacaccgggtgatcggagcgaccggccaatgccgcagcgatggccggtgcggtggcgtcggcgattgggtcgagggacaggtaatcggtctgcaccggtttgccatgggtgatcgtgcctgttttatccagcgccagataatccagtttgaaaccgccctccagatacacgccgcccttgaccagaatgcctttgcgcgccgctgcggcgaggccgctgacgatggtcaccggcgtcgaaatcaccagtgcacatgggcacgcgactaccagcaacaccagcgcgcggtagatccagtcgaaccacacggcgcccatgaacagcggcggaatgatcgccacggccaaggcaaacacgaacaccaccggcgtgtagattttcgaaaactgatcgacgaagcgctgggtcggtgcgcgcgcgccttgggcctgctcgacggcgtggatgatgcgcgccagggtcgagttgttcgccgctgcgctgaccgcgtattccagcgaaccggcctggttgatggtgccggcgaaaactttgtcgccaacggttttctcaaccggcaaactttcgccggtgatcggcgcctggtcgatggtcgaactgccgctgagcacttcgccgtctagcgcaatgcgctcgccgggtttcactcgtacgcgggcgccgagttcgacgcttttcacgtccagctcaatccacgaaccgtcagcctgcaacaccgtggcttgctccggcgtcatctgcatcaggccactgatcgcgttgcgcgcacggtccagcgagcgcgcttcgatcaactcggcgacggtgaacaggaacatcaccatcgccgcttccggccattggccgatgaggatggcaccggtgacggcgatgctcatcagcgcgttgatgttgaggttgcggttcttcagggcgatccagccctttttataagtggtcaggccaccgctgaggatcgacaccagcgcgatgatcgccaccacccaggtcggtgccgcgttggtgaagtggatggcttcagcggcgagcgcgccgacaccggacagcgccagcggccaccagtgttttttaaccggtgccggggccggcgcttcgacgcccgcctccagcggctcggcgtgcatgccgagggatttgatcgcctcgatgatcggttcggtgcctggcagattgtgggtcacaccgagtacgcgattgatcagattgaattccagctgctgcacaccggcgagtttgccgagcttgttctgaatcagggtctgctcggtcgggcagtccatcgcctcgatgcggaagctgctcaggcgcgcatcggcactggttttttcgctcaattgcaccaacgcaggcgcagcgactttcgacgagcagcaggaatctgcgtgcgcatgaaccggtgccggcgctgcgacttttgacccacagcaagcatcgccgccgtgtgaatgtttatgcacaggctgcaatttatgactgtgatcgtggccgtcgccgggcttatgggtgtgctgggaatcgctcattggtcgcgtccgtgaaggtgcctgttgccaagtaaagaccctgtagccactatagggtcaagcacccttttggagattgccgtcatgaagatcggagaactggccagactcaccgactgcgccgtggaaaccatccgctattacgagcgcgaaaacctgctgccggaaccggcccgcagcgacggcaactaccgcgtctacactcaggcccacgccgaacgcctgaccttcatccgcaactgccgcaccctcgacatgaccctcgaagaaatccgcagcctgctggccatgcgtgacagcccgcaggatcagtgtgaaagcgtgaatacgctgatcgacgagcacattcagcatgtgaaggcgcggattgatggcttgttggcgttgcagacacagctgctcgacctgcgccaacgttgtggcgaagggccgatggctgatcaatgcgggatattgcagcggctggaagtgagtggcggggttgttgcgacggaagtggaacactcccacgtaggccgcagccacggccattaagactcacgcaaaaccaaatgtgggagcgagcctgctcgcgaaagcggtgtatcagtcgacatctctatgactgacacgccctcttcgcgagcaggctcgctcccacaggggttttatgcaacggcttagaccgccatcggcgcggtcattggcgcgtggtgctcatagccttccagcgagaagtcgctcggctcgaccagttccagccattccggctgatacacgccagtcttggcaaactccggcacgcgatcggagattttcagtttaggcatggcgaacggctcgcgcttgagctgttcgttgagcatgtccagatggttctcgtagacgtgcgcatcaccgatgaaataggtgaaccagcgcggcgtgtagccggtcaggcgaccgatcaggctcagcagcgcagcgccttcggtgaggttgaacggtgtgcccagacccaggtcgttcgaacggatgtagagggtcagggaaatttccttggtctcgacattcgggtggaactggtacagcaggtggcacggcggcagggccatttcatccagctgggcgacgttccagccgtggaacagaatacggcggctgcccggatcgttgatgatcgtgtcgacgcactgacgcacctggtcgatggctttgtacagcaccacgtaggcctggccgtcttcttcgccttgggcaatctgcttgtagccgttgctcaaggtttgttcgatggccgcagtgttgctcagcgggatctgcttgtacgccggccatttgcgccattgcacgccgtagatttcgccgaggtcatcgtcgccctgacggaacgggttggccagccactgcgcgttttcgttggcgttctggtcccagaccttgcagcccagcgcacggaattcagcggcgttgttcacgccacggagaaatccgcacatctcgccgatggccgatttgaaggccattttgcgcgtggtgatcgccggaaaaccttcctgcagatcgaaacgcagcatcgcacccggaaagctgatggtgttgatgccggtgcggttggcctgtttgctgccgttcttgatgacgtgcgagaccagttcgagatattgcttcatgagttacctgtgtcctttgagccccggcgtcgcgcgccggggttcgtagtttaagccgtcggcgcgagcggtgctgccggtgcgcgacgataggccagccagatcaggaacagcccgccgacgatcatcggcacgcagagcacctggcccatggtcagccagttccaggccaagtagcccaactgcgcatccggtacgcggacgaattcgacgatgaaacggaagatgccgtagaacagcgcgaacatgccagaaacggccatggtcggacgcggtttgcgcgagaaaatccacaggatcaggaacagcgccacgccttccagtgcgaactgatacagctgcgacgggtgacgcggcagctgcgccggatcgctgaatggcgggaagaccatggcccacggcacgtcggtggctttgccccacaactcggcgttgatgaagttaccgatgcgcccggcgcccagaccgatcggcaccattggcgcgacgaagtccatcaactggaagaacgacttgccattgcgcttgccgaaccacaacgcggccagcatcaccccgatgaagccgccgtggaacgacatgccgcccttccacacttcgaaaatcagcgtcgggttggccagataggcgctcagatcgtagaacagcacgtaacccagacgtccgccgacgatcacgcccatcgacatccagaagaccatgtcggagagtttctccttggtccaggtcgggtcgaaacggttgagccggcgcgacgccagcagccacgcaccgccgatgccgatcaggtacatcagaccgtaccagtggattttcagcggaccgatggccaaagccaccgggtcgatctgcgggtaaggcagcattgcgactcctcgttagagttgaaaccaaaattcccgggcgacgctgccacctcaggattaagccaggattgcgacgcgattaaagcaggaagctcacacccacgctgaacagcaaagcggcgaacagccgtttcagcaagcgcggcgacaaccgatgcgccaaacgcgcgccgatacgggcgaagaccatgctggtcagggcgatgcccaacaacgccggcaaatacacaaaaccgagactatgcggcggcaacaacggatcgtgccagcccagaatcatgaaacttaatgcactgaccaaggcaatcggcagaccgcaggccgatgacgttgccaccgcttgctgcatcggcacactgcgccaggtcaggaacggcacggtcagcgaaccaccgccgacgccaaatatcgccgaggcccagccgatgatgctgccggccacggtcagaccgagtttacccggcaccgttcggctggccttgggtttgatgtccagagccagttgcaccgagatgatcaaggcgaacacgccgatgatcttttgcaagtgcgggccggaaatcgcttcagcggtcagcgcaccgaaacctgcaccgagcagaatgccgacggccatccacatgaagatcggccagcgcaccgcgcctcgtcgatgatgctcacgcacggcgttgaccgaggtgaagatgatcgtcgccagcgacgtgccgaccgccagatgggtgagaatcgattgatcaaagccctgcaaggtgaaactgaacaccagcaccgggacgatgatgatcccgccgccgacgccaaacagtccggccagcacgcccgcacaggcgcccagcgccagatagagcagaaattccatgaccgtctccccagaccgcatccccaaaaccggagcggcatggtaacggatgcacaccctttggctccactggcgatggatgcacggacgccggatgcgtagagtgagcaaaaaacacacaaggaccaccttatgtgcctgattgttttcgcctggcgcccgggccatgcccagccgctgatcgtcgcggccaaccgtgacgagttttatgcccggccgagtctgccgctggcgcagtggcctgaagcgccacatgtgcacgccgggcgtgatctggaggccggtggcacctggctggggatcggcgccaacgggcgctttgcggcgctgaccaatattcgtgatccgcagcagccgccggcgcgcaagtcgcggggggagttggtggcgcggtttctgaccggtgatctgtcgattgatgattatttgatcgatgtggttgggcgttcggcggaatatgccgggttcaacctgctgctcggcaatagtcatgagctgtggcatttcaatgcgcggctgtcagagccgatcatgctggagcccggtgtttacgggctctccaatgccgggctggatacgccgtggccgaagttgctcaaggccagggcggcgttgggcgcagtgctggatgatccgacgcctgcgcggttgctggggttgttgagtgatgcgcagaccgcgccggaagcggaattgccggataccggggtggggatggcgacggagtcattgttgtcgagtgtgtttattgccagccagagttacgggacgcgggcgagtacggcgttgattgtgcaggcggatggggcgcggcggatggtcgagcggagttttgggccgtatggcgggcatcttggggaagttgaggtttgtgtctaagagcaaaccctcaccccagccctctcccaaagggagagggggccgaccggggtgtcttgggccatacatcgacctgaaagactgagttgattatggattcagcaaggcactttcaggtcggcggagttctgcagcatcccccaatcagtcccctctccctctgggagagggttaggcgggcggcgttccgatgaggggcttttgatcttcagagcgctttgaccactgccggcggatgcatcttcgacaacccaaggttcttcagcgccaattgcagcgagctgtggataacttgcgggttatcaatggtcatcagctccgccagcaaatccttggccttgctcagattgacctggcgcagcatccacttgaccttcggcaagttggtggcgttcatcgacaaactgtcgaagcccatcgccatcaacagcaccgccgccgccggatcaccggccatctcgccgcagatactcaccggtttgccttcggcatgggcatcgcgcaccacggtttgcagggcttgcagcaccgccggatgcagataatcgtagagatcggccacacgtgggttgttgcggtcaaccgccagcagatactgggtcaagtcgttggaaccgacggacaggaagtcgaccatccgcgccagttccttggtctgatacaccgccgccggaatttcgatcatcacgccaatcggcggcatcggcacgtcggtgccttcgtcgcgcacttcgccccaggcccgatggatcaggtgcagggcttcttcgagttcgtgggtgccggagatcatcggcagcagaatccgcaggttgttcaggccttcgctggccttgagcatcgcgcgggtctgcaccaggaagatttccgggtggtcgagggtcacacgaatgccgcgccagccgaggaacgggttgtcttccttgatcgggaagtacgacagcgacttgtcaccgccgatgtcgaggctgcgcatggtcaccggttgcgggtggaacgcggcgagctgctcgcggtagatcgccagttgttccttctcgctcgggaagcgctggttgatcatgaacggcacttcggtgcggtacaggccgacaccctcggcgccacgcttctgcgcccgcgccacatcggcgagcagaccggtgttgacccacagcggcatgcggtgaccatcgagggtcacgcacggcaggtcgcgcagggtatcgaggcccagcgccagttgtttctcttcttcgacgacttcggcgaactgcttgcgcagcacttcgctcgggttggtgtaaacctcgccgcgtgtgccgtcgacgatcatttcgatgccgtcgaccttggcgtacggcaggtcgaccagacccatcaccgtcggaatacccatcgcccgggccaggatcgccacgtgggagttacccgaaccgagtaccgagaccagaccgaccagcgtgccttccggcacttcgccgagcatcgccggcgtcagctcttcactgaccagaatggtcttttccgggtagaccaggttctgctgacgctcttcctgcaagtaggcgagcaggcgccgaccaaggtctttgacatccgacgcacgctcacgcaggtaggcgtcgtccatcagttcgaaacggttgacgtgttccgtgaccacctggcgcagcgcgccctgggcccattggccggtcttgatcacggtggtgatttcgctgcccagcgaggcatcgtcgagcatcatcaggtagacgtcgaacagcgcacgctcttccgggcgcaactgggtcgcaagcttggcggacaacgcgcgcatgtcggcgcgcacgccttcgatggcggtcttgaacagcgccagctcggcgttgatgtcggtgatggtcttgtccggcaccacgtccagatcagccggcggcagcatgaccactgcagtaccgaccgccgcacccggcgaacccggcacaccgacgaacttggcttcctgaatacctttgccctgacgacccagaccacggatcgaaccggtggcctcggcgtgggcgattacgccagcgagctgcgcgctcatcgtcacgaggaaggcttcttcaccttcgtcgaactgacggcgttccttttgctggatgaccaacacgccgacgacgcggcggtggtggatgatcggtgcaccgaggaacgaggcataccgctcttcaccggtttcggcgaagtaacggtagcgcgggtgatccgcagcgttttcgaggttcaggggttcttcacgcgtgccgaccagacccaccagaccttcgttgggtgccatgctgaccttgccgatcgagcgcttgttcaagccctcggtggccatcaggacgaagcggttggtctcgggatcaagcaggtagaccgagcagacctggctgcccatggcctctttgacgcgcaacacaataatccccaacgccgccttgagatccttggcggagttaacttcctggacgatcttgcgcagcgtattgagcatggctcggggtcgaactccgtcgtcagtcgcgcactaaaaggcgcggggcaagctctttgagggcgcggcgatacacctcgcgcttgaatgtcaccacctggcccaacggataccaatagctgacccagcgccagccatcgaactccggtttaccggtcaaatccatccgcacccgctgctcgttggagatcaggcgcaggagaaaccatttctgtttctggccgatgcacagcggttggctgtgggtacgcaccagacgttgcggcaaacgatagcgcaaccagccccgagtacaggccagtatttcaacatcttcacgttccaggccaacttcttcgttcagctcgcggtacaaggcgtcttccggcgtctcttcagggttgattcccccttgcggaaactgccaggcatcttgattgatacggcgagcccatagcacctggccggcgtcattcgtcagaatgatcccgacattggggcggaaaccatcggggtcgatcacggcaacaacctcgcaaacgcatgtcgccgcattgttccacaaaggttgataaggcggcaacgaagcttcctaccttatgtgcactcttgtgaaaagaccgtattcttgtcgcctttttacagacttatcagcgggtaactgcaatgcgcctggcactcttcgatttggacaacacccttctgggcggcgacagcgatcacgcttggggcgactatctgtgtgaacgcggcttcctcgatccgattgcgtacaaagcgcgcaacgacgagttctatcaggattacctggccggcaaactggataacgccgcgtacctgaacttctgcctggagatcctcggccgcaccgaaatggccgtgctcgatcagtggcacaacgattacatgcgcgactgcatcgaaccgatcgtgctgccgcaggcgctggaactgctgaaaaaacaccgagacgctggcgacaaactggtgattatcaccgcgaccaaccgcttcgtgacggcgccgattgctgtgcgactgggcgttgaaaccctgatcgccactgaatgtgaaatggttgatggccgttacagcgggcgcagcactgatattccgtgcttccgtgaaggcaaggtgacgcgcctgaaccgttggctggaagagaccgggcattcgctggacgacagctatttctatagcgattcgatgaatgacttgccgttgctggagcaggtggcgaacccggtcgctgtcgatccggatccgaatctgcgggctgaagccgagaagcgtggctggccggtgatttcgttgcgcggctgatatcgctatcgcgggcaggctcactcctacagttgaccgcgtttcaacgttggaacgcggtcaactgtaggagtgagcctgctcgcgattgggtctacgcgatctcaagccctagacaggcttggcccccatcaacgccgcaatggcgagaaatccgatgccgctgacaatcgccagcgccaacgtgaatttccggttaccaaccccgctagtccacaaccgattaagccgcaccagcaaccacactgcactcaacgtggccacggcatagatcacgctggaccccagaatccagaactgccccagtggccagccgatcaggtggaccaaccaccagccggtgaaaggcatgctcagcataccgatcagcatcaaacaccagataaacagccagggacgctgcatcgtgctggccggcccttcgctgcgattacgccaggtcagagcggcgagccccagcccgctcgcgagtatgaccacggtcgccgcgacgtgaaggactttcagggtggtcagggtttccatgtacttctcttccttgggccatgcccatcagcgtagccgctcagccaagaaacagctgataggccgggttctcgctttcgtcccagtacggataaccgatttcctcaagcgccgccggcaccagatgacgctcatcgtgcggcacctgcaggcccgcgaccacacgaccatcagcggcgccatggttacggtagtggaacatcgagatattccagcgcccaccgagcttattaaggaagttgaacagcgcgcccggacgttccgggaattcgaagcggaacaccacttcatcaatgacatgcgccgcgtgaccgccaaccatgtggcggatgtgcagcttggccagttcgttgtcggtcaggtcgataaccgggaagccctgctcggtcaggctcgccagcagcgcgctgcgcgggtcgttttccgggtgagtctgcacgccgacgaagatgtgcgcttcgctgccggtgttgtagcggtagttgaattcggtgatctggcgcttgcccacagcctcgcagaacgctttgaagctgccggccttctcggggatggtcacggcgatgatcgcctcgcggccttcccccagttcggcgcgctcggcgacatggcgcaagcggtcgaagttgacgttggcgccggagtcgatggcaacaaaggtctggccattgaccccgcgctgctcgacgtacttcttgatcccggccacgcccaacgcgccagcaggttcggtgatcgagcgggtatcgtcgtagatatccttgattgccgcacagatctcgtcggtgctgacggtgatcacttcatccacatagtccttgcagatgtcgaaggtgtgctgaccgatctgcgccacggccacgccgtcggcaaagatgcccacggtcggcagcaccacgcgctcaccggcggccatcgccgcttgcaggcaattggagtcgtcaggctcgacgccgatgactttgatgtccgggcgcaggtatttcacgtacgcagcgataccggcgatcagaccgccaccgccgaccgggacgaaaatcgcgtccagcggctgcgggtgctggcgcaggatttccatcgccacggtgccctgcccggcaatggtgtgcggatcatcgtacgggtggatgtagacgtagcctttctcatcgaccagcttcagcgagtaggccagggcttccgggaacgaatcaccgtgcagcaccactttgccaccgcgcgaacgcacgccttcgactttgatttccggagtggtcttgggcatgacgatggtggctttgacgcccagtactttcgccgccagggccaggccttgcgcgtggttgcccgccgatgcggtgactacgccacgggcgcgctcttcatcgctcagttgcgtcagcttgttgtaggcgccgcgaatcttgaacgagaacaccggctgcaagtcttcgcgcttgagccaaatgtcattgcccagccgctcggagagctggcgagcgttctgcagcggggtttctacggcaacgtcataaacgcgcgaggtgaggatctttttgacgtactgttcgagcatcggaaagcatcactgagcggttgagcgggaccgaggagtctaacccggcttttgcccgcacgaccacacgaatccagaggttttagccgcgcttgcggctataatgccggcctttccgttctctccttgcccgcttccggagcccgcatgacccaggatcaactcaaacaggcagtggctcaggccgccgtcgacttcatccttccgaaactcgacgacaaaagcatcgtcggggtcggcaccggctccactgccaactgcttcatcgacgcactggctcagcacaagggcgcgttcgatggcgcggtcgccagttctgaagccaccgccgcgcgcctcaagggtcacgggattccggtgtatgagctgaacaccgtcagcgacctggagttctacgtcgacggcgccgatgaaagcgacgcgcatctgaacctgatcaagggcggcggcgcggccctgacccgcgagaagatcgttgcggccgtggccaaaactttcatctgcatcgccgacgccagcaaactggtgccggtgctgggcgagttcccgctgccagtcgaagtgatcccgatggcccgcagccacgtcgcccgccaactggtgaaactgggcggcgacccggtgtaccgcgaaggcgtgctgactgacaacggcaacatcattctcgatgtgttcaacctgcagatcaccaacccggtggaactggaagcgcagatcaatgcgattgttggcgtggtcaccaacggcttgttcgcggcgcgtccggcggatctgttgttgctgggtaccagcgaaggtgtgaaaaccctgaaggctgagtaagtccagtcacccacacatctgtggacagacgaataaaccggtaggagtgagcctgctcgcgatagcggtgtgtcagttgatataaatgtcgactgacacaccgctatcgcgagcaggctcactcctacattggttttgtggtgttggttagtttggcgttggttttttgaagacgtagaacaggttcggttcgctcaccaggtacagcgtgccgtcatcatccatcgcaatcccttccgcctgcggcacggttttcttcaaaccctgacgcccgccactgatcgacatggtgctcaacggacgcccgtcgacatccagctccagaatcaatcgcgactcatccgacagcgccagcaaatgcccgctgcgctcgtcgtactgcaaactcgacagatcgcgcacgaacatcccggcatcgcgcttggggttgttgatcacgtgcaccgcgtaggacttttccgggttgaagtgcggaaagccatgcacttcgtagatcagcatcggatcgcgctcttttgcaacaaacaggcgcttgccgactgaatcataggccaacccctcgaaccccttgttgccactcatgtgcacaccgagggtcatctgctcggcgtcggccgcatcgaggaaggtcgtgtctttttccagatgaatcttgatcagccgctgctggcgctcatcagtgatcacgtaagtatcggcgctgatgaactcgaccgcttccgggtcgccgaagccgatcagggcgatgcgccgcaggatcttgccctccagcgacaactcgaccagttcggcattcttgttggtcacggtgaacaggcttttgcgcaccggatcgaaggtcaatgctgaaacatcgtcgttcagcccgtcgatgacccgcgcctcgatctcgacccgatattggtccagagcaatggactcactgctctgcgtctgccacaacgtatgcaggttgaaccaggcacgctcgaacaggcgcatgtattggccgatcgcaatcaacgcgatcagggccatcaccgacagaaggataaacagaggtttgggacgggcaagtcgacgcattcgggcgggctcgaagtcaaaacaggcggatgaaatatcacgcacgtctgaactgaagcttaatggccacttgcctgtcaggacaatcagacttgtctgaaattgccgcgaggacagttatcgctgtttttcgaagcgataaaacaggttcggctcgctgaccatgtacagcgtgcccgcctcgtccatggtcacgccttcggcgcgaggaatggttttcttcaggccgttgaaaccgccaagcaaggtcatgaaactgacctgttcgcccttctcgtccagttccaggagcaagtgcgaatcagcggagagcaccaatgtatggccggtgcgcggatcaatggccaaggctgagaggttgcggatatccagctcatcgctatccagcttctgcttgtcgcccttcagcgtctggctgccgtcgcttttccaggtaaacaacgccggcggtcgttcctcgcccagcagcagttgctgattgcgcgggtcccaggtgatggcttcgaaagccttgttctgatctttcgacgggccgaggtcgtatttcgggaaatcggcgatattcagctcgcgggtgttggcgtcgactttgacgatagagagcatgtgctcacgctcgtcgacaatcgccatcaagccgttttccatgacggtcaggccttcgggattgctccagcccttgagcggcatcttgcgcagaacatcgccttgcaggctcagctcagcgaggaacgggttcttgcccatcaccgaaaaaagggttttggtctgcgggttataggacaggtcggaggcttcgtccttctccatgcccggcagcaactttgcatcgatcactgcgcgatagtccggtagccagacgctttccttctgctcggccgggctctcgaaacgctccagtacccagagcacgccacggtcatcccaatgcatggcgaacgccaggccataagcggcgacaatggccagtagcagccaggaataccaacgcagggcaaaacgagagcggcggacgggtttgagctgagttggagaggacatcgaaggacgcgttccgaaaattcaggctatgggtaatagcacaaagagaccggctcagacgccagaattacggaaattatccagacaggatgtgaaaaaaacggcaaatggcgggattgtcgtgtgttgccggcaactttcagggcgccacaaaacaatgtgggagcgagcctgctcgcgaaagacggagtgtcaggcaacgatgatgtcgactgacctggcgccttcgcgagcaggctcgctcccacaggggatttgcggcgtggcgattagcgcacgctgctggtgaagctgctcgcaccgaccagttcgaggacgatgtcgtcaccaacattcaaggggccgacgccgactggcgtgccggtgaggatcacatcaccggcctgcagcgagaagcagccagccatgtgctggatcatcggcacgatcgggttgagcatcgcgctgctgttgccgtcctgacgcacttcgccgttgatggtcaggcgaataccgatgtcggtcagatcagcgaaggtgctgccgaccacgaacggagcaattaccgctgcgccgtcgaacgacttggcgatttcccacggcaggcccttggctttcagctcggcctgcttgtcgcgcagggtcaggtccagcgccggggcgaaaccggagatggcgtcgagcacttcttcacggcttggcttggtcgacaatggcttgccgatcaacacggcgatttccgcttcgtagtgcaccgagccgcgctcggtcggaatggcaaaaccgccttccagcggcaccacgcaactgcccggcttgatgaacagcaacggctcggtaggtaccgggttatccagttccttggcgtgttcggcgtaattacggccaatgcacacgactttcccgatcgggaagtggatgcgcgtgccgtcgacgtactggtgctgatagctcatttaccgactcctgccttcattgattcatcaaagattacagatcaaaccgcgaagatcttgcccgggttcatgatgccgttcgggtcgaacaccgctttaaccgctttcatgtactcgatctcaaccggcgagcggctgtaggtcaagtaatcgcgcttggtcatgccgacgccgtgctcggcggagatcgaaccgttgtacttctcgacggtttcgaacacccacttgttgacggtcgcgcacttggcgaagaactcgtccttgctcaggttatccggcttgaggatgttcaagtgcaggttgccgtcgccgatgtggccgaaccagacgatttcaaagtccggatagtgctcgccgacgatcgcgtcgatttccttcaggaacgccggtactttcgacacggtgaccgagatgtcgttcttgtacggcgtccagtgcgagatggtttcggagatgtattcgcgcagcttccacaggttctgcagttgggtttcgctctggctcatcacgccgtccagcacccagccctgctcgacgcagtgctcgaaggtttccaatgcgctgttggccacttcttccgtggtcgcttcaaactccagcaacgcatagaacgggcaatcggtttcgaacggcgccggtacgtcgccacggcccatgactttggccagggctttgtcggagaagaattcgaacgcggtcaggtcgagcttgccctggaaagcgtgcagcaccggcatgatcgaatcgaaatcggcggtgccgaggaccatcgcggtgaggtttttcggcgcgcgatcgaggcgcatggtcgcttcgacgacgaaacccagcgtgccttcagcgccgatgaacagctgccgcaggtcgtaaccggtggcgttcttgatcaggtctttgttcagttcgagcacatcgcccttgccggtgacgactttcatgccggccacccagttacgggtcatgccgtagcgaatcactttgatcccgccagcattggtgccgatgttgccgccaatctggctggaacctgccgaggcgaagtcgaccgggtaatacaggcctttttcttcggcgacgttctgcaaatgctcagtgaccacccccggctgacaaacggcggtgcggtcagtgaggttcacgtcgagaatctgattcatgtagtcgaacgacaccaccacttcaccattcgccgccaccgcagcggcggaaagcccggtgcgcccgcccgacggcaccagcgccaccttgtgcgtattggcccagcggacaaccgcctgcacctgctcgatggtcttgggaaacacaatggcgctgggcgccggggcgaagtgcttggtccaatccttgccgtatgcattcagggagtcggcgtcggtcaggaccttgccaggctcgaccagggtcttcagttcatcaatcagggcaggattggtcatcgacagaactctcgaacaattcatggtcatcctgagaacgcttcacgtcgcaggaatgagtgtttagcggggaggctatgctagcatatcgaccccgcaggacagtgcccaaggccagatccgcggagacgactttcttgtcgtccgggtcagcgtctgttgaccatttcctgccatttttctccgggatacaggtttacgcagatgagcaagacttctctcgataagagcaagatcaagttccttcttctcgaaggcgtccaccaatcggctgtcgacgtcctcaaggcggcgggctacaccagcatcgaatacctgacaggttccttgccggaagcccagctcaaggaaaagatcgctgacgctcacttcatcggcattcgttcgcgcacccaactgaccgaagagatcttcgatcacgcgaagaagctggttgcggtcggctgtttctgcatcggcaccaaccaggtcgacctgagtgctgcccgtgagcgcggtattgccgtgttcaacgcgccgtactccaacacccgctccgtagccgagctggtgctggccgaagcgatcctgctgctgcgcggcatcccggagaaaaacgcttcctgccaccgtggcggctggatcaaatccgcagccaattccttcgagatccgtggcaagaaactgggcatcgtcggctacggctcgatcggtacgcagctgtcggttctggctgagggcctgggcatgcaggtgtacttctacgacaccgtgaccaagctgccactgggcaacgcgacccagatcggtagcctgaccgagctgctgggcatgtccgacatcgtcaccctgcacgttccggaaaccgctgcgacccagtggatgatcggcgagaaggaaatccgcgccatcaagaagggcggcatcctgatcaacgcggcgcgcggtaccgtggtcgagctggacgccttggcggacgcgatcaaggacaagcacctgatcggcgcggccatcgacgtcttcccggtggagccacgctccaacgacgaagaattcgaaagcccgctgcgtggcctcgacaacgtcatcctgaccccgcacatcggcggttcgaccgccgaagcgcaagccaacatcggtctggaagtggcagagaaactggtcaagtacagcgacaacggtacctccgtttcgtcggtgaacttcccggaagtggccctgccggctcacccaggcaagcaccgcctgctgcacatccacgagaacatcccgggcgtgatgagcgagatcaacaaggtcttcgccgaaaacggcatcaacatctccggtcagttcctgcagaccaacgagaaagttggctacgtggtgatcgacgtcgacgccgagtactcggacctggcgcaagagaagctgcagcacatcaacggcaccatccgtagccgtgtgttgttctgatcgaacgctgagcgacaaaaaagggagccttcgggctccctttttcatgcacggcgaaacggttattcgacgttgatggtgattttcttcgagacgattggcggatcgaatgccatgtgaccgctgtcgccaagttccagctgcaaggtgtgtttgcccggggcgagcttgatgtcagcctgggtctgcgccttgccgaagtgcatatggttggcatcggtagggacgaccgaaccggcaggaacaatgtccttggcgtcgatcagcaggtgatggtgaccggtgttcttggtgacatcaccggccggcgccagggcgacgtccttggtaccgaacttgaccgtgaaagtctgcgaaaccgtggccccgtcctcgggagaaacgatgaacacttcggcgccttttggcgcgggtgtggcagcactggccagcaccgaaacacccatcagcacacccgccaacgttgcacgtgacataaagcttttcattttcttctccagttttccgtaaaatccgcacggtcatgacaacttcatgaccattcgttgtcgaaggcactcgacaaccatagcaaagcgagcctgactcagagcgtcgcattaatgatttcaaaggagtgaccatgcgctttttgcctggcctgatctgcctgctaccccttttgagccctttggctcacgccgaactgattgatgacgtcaacgaccgtggcgagctgcgcatagcccttgaggctaatacaccgcccttcaattacaaggatgacggcgacaaactcacggggttcgaggtcgagcttggacaactgttggctaacgagctggatgttcgcgccgacttcatcgtcaccgacgaggccgatctgctccagggcgtcgaaagcggcaagtacgacgtcgcgctcaatcacatagcactgacacccgaactcaaggatcgtttcgacttcagcgaaccttatggcaaggtcgattcgcagttgctggcgaagaaagatgaacagccgcagccgatggtcttggtgcagacgctgaccgacgccaagccaaaggcaagcgcaccggtggagttggcgataccgtttcagaagggtaatccggcgtttcaggccagccttgcgagcgcgatgcagcggatcaaagcggatgggcgtctggcggcgttgtccgaaaagtggctcaccgaacccaagtgaacacaaaacctgtaggagtgagcctgctcgcgatggtgtcaggtcagttgacataaccgttaactgacacaccgcgatcgcgagcaggctcactcctgcacgggacctgtgagaggtttttagtcgagttgggccaaggcttctgcggcctgcggcaattcgagctcgctgaaaacctgcacaccatggcgcttgagcagcgcagcggtgacgccttcgccggagaccttcacaccgctgaacgtcccgtcatacgtcagcaaattcccgcaagaaggactgttggctttcagcacagccacacgaatcccgtgcttctgcaccagctccagcgcctgccgcgcgccatccagaaactgcgcactgacatcctcgccatcagtggtgatcaccgcagcgacgccatccagcacctcagcaccctgcccgcccggaatctccgccgccgcccgtggcgtcggcaaccccccggcaacctccggacacaacagcaccacccgcccttcggcaatccactgttcaagcagatcaaacggcccgctcgcgccaccgtcgtaacgcacgcgatgacccaacaggcagcggctgaccagaatcttgtccatctcagaacggctcgttgccacggcggcggaaccagccggtcagcgacaggcgctcgcggtgcgctggcaatacttcgtgcggcacttcgccggaaagaaacaccaccagacagccgccggtaggctgcacgtcatgcacgcgctcatcgttcaggtacatgcgcaactgaccaccgtcctccggcagccacgcgtcattgaggtagaccaccaccgagaccatgcgcttgtcatcgtcgcgaaaacggtcgacatgccggcgataaaacgcgccgggcggatacagggcgaaatggcattcaaaatcttcgaggccgaggaacaagccccggttgagcgcctcgcgcaggctctccatcagattcagataacggtcgctggactcggcctgaccggggtcgatccactgaatatggtcgccacgaattccttcacgaatctctgaaaacggcccacggccaaccgctgccggcgccagctcaccttcggcctcacgtttacggcactcagcggccagctcgcgggtcaaaccggcgggcaggaagatgttctgctgcgaccagccatgctcggccaggtcgtcgacaatgcgtaacagcagcgggtgttcagaggatatttgcatggcgcgcatagtatgccgccggcgaaaaatccgacagagccacgcggcggcttgatacgaattctcgacaagtaccggcaccgcacggagaatagtccgctgctgacaggagtccctatgcgccgtttgcttttttcactgttgatgttctgcgttttgcccgcctgggcggacggccacgatcagctgtacaaggtcgccggctggccagaacaacgcgcgcatttcaacgacgccctgacggctgcacagcagcgttatcagaacagtctgccgcccgccgtttttcaagcgctggtcaacaatagtaaccagcgcttcgccccgcaggccgtggatcaacgcgccgaagcacaactgcggcagaagcttgccgacccgaaaccggcactgaccttctttcaatcgccactgggcaaaaaaatcgtcgccgctgaactgctcgcgacccgtcgggatcaactggcgaaaaacgccaaagggctgccgaagatgcaggtcagcgacagccgtctgctgatcatcggccacctcgctcaagcattacctgcccgtgaagccggcgccgaagtcagcctggcgattgccggcgtcgcggcagacagcttgagctcgatgattccgggactgctcggcggtggtcaggcgcagggtatgttgaacggtcagcgtcagcgcttgatggatcagattggcgcggacatgaacaacacgttgctctatgtctatcgcgatctgtcggatgaagagctggaagagtttgcgacgtttgccgagtcggctgagggcaaggcctactatcaggcggcgttggcggcgattcgggcggggttggcggtcgggcaatgatcttcgtcgtctcttagaccgctatcgcgagcaggctcactcctacaggggtacgcattccaaatgtaggagtgagcctgctcgcgaaggggccctcacaagcgctagagattccggcccctgatgcgcttgctcaagaactcgaaatactcctcacgcatctccaccgtctcattcgccagatgatgccgggcctcggccagtagcagaatctgcggccggtcgaacttccacttcaacacctgcaaattgtgctgccagtccaccgtcatgtccgcctgcccctgaatgatcagcggccgtcgcggactttttttcgcgtgctcgacgcgaatgatccaacgcgacaacgccccaacccacttggtcggcaagcgtcgtggctgcagcggatcggcctgtaggaatggcaggaaatccggatcgttggagttctcgctgaaacgtcgcgcgacacctctgacgaaaggtctgagcaggtaataactcagctgcgaccagccccacgctcgcggccgaaccagcggcgccatcaaaatcacttggccttgcgccgggctgttttcgccatggttgagcaggtgatcgaccacaatcgccccgccggtgctctgcccgcacaaatgccacggctgcggcagcgcgatcgattgcgcctcggcgaacaaggcttgcagaacgtcctgatattccgagaagtcgcgaatgctcgcgcgcggcccgctcgatagaccatggcccggtaaatcgcaggcgatcacggcaaagtcctgatccagcgcccactcgatcacatgccggtagagcccggtgtgatcgtaataaccatgcagcagaaacagcgtcgccttgaccttctccggccaccagcaatggctgaccacttcataaccatcgacctcgaaacggcccatgccacgccagacatcgcgatggggaaaatcggttttataaaactgctggtacgccttggcctcgtccgacaacggctgccactcggccaatggcttgaggctggcgcggatttgatcggggtcgaaagtggcaggcatgcgggaattccaaaacggtaaacagactttatcggcctgcgatattcatctgtcgtggcagacatggcaagctagcccaccttttcgggatcgaaaaccatgcgttcgccctaccgcaccgcactgtttgccagtctgctcgcgctgatctgcgccggggtgctgtgggccgcgtacgactggtttcaggggcgttacctgcgcgcattcagcgaacacaccgcggtgttttccggtgatccgctgcgcctgccggacaatctcgccggtcccggcaagatccgtctggtgcatttctgggacccggcctgcccgtgcaatgtcggcaaccaacagcatctgaccgagatggtcgagcagttcggcgccaagggtgtcgagttcttcgcggtgcaaaagactggcagccacgggcagttgccggccaacctcagcagtctgaaaaccatcacgatattgcccggctccgagcaagtccccgccagcccggccgtggcgatctgggaccgcagcggcaaactggcctacttcggtccgtacagcgaaggcctgacctgcaattccagcaacagttttatcgaaccgattttgaatgccctgacggaagatcgcccggtcaacgccacgcacaccctggcagtcggttgttactgcccgtggccggttgagactcagtaaggcattccggacttttcaaggacagcgctgcacggcacagaaggtctgtgctaattgtttgcagcccgacgggcggcaatcccgcctgcacaaggagtcaccatgaagcgcgtgttcaccgtacttggcttgctcatcgttgttctgcttgccggcgtcggctggtatgtctacagcaaacaacccacgcgccagggccaggtcgaactacgcaacctgcagggttcggtgaccgtgcgctacgacgaacgcggtgtgccgcacattcgtgccgagaacgaaaccgacctctaccgcgcgctcggctatgtgcatgcccaggatcggctgttccagatggaagcgatgcgccgtctggcccgtggcgaactggccgaagtgctcgggccgaaactgctcgacaccgacaaactgttccgcagcctgcgcatccgtgagcgcgccgccagttacgttgccagtctcgataaacagtcgccggcgtggaagggcctgcaagcctatctggatggcatcaaccaatatcaggacagccacgctgcgccaatcgagttcgacgtgctgggcatccccaaaagaccgttcacggcagaagacagcatcagtgtcgccggttacatggcctacagctttgccgccgcgtttcgcaccgaaccgttgctgacctacgtgcgcgatcagttgggcgccgattacctcaccgtcttcgatctcgactggcagcccaagggcgtgctggtcaacggtcatgccaagcaggtgccagcgctcgccgccggcgactggaaagacctcaacgcccttgctcgcctcagcgaacaggcactgatcgacaacggcttgccgcagttcgaaggcagcaacgcctgggtgatctcgggcagtcgcagccagagcggcaaaccgctgctggccggtgacccgcacattcgtttctcagtgccgtcggtgtggtacgaggcgcagttgtcggcgccgggttttgagctgtacggccatcatcaggcgctggtgccgtttgcgtttctggggcacaacctcgatttaggctggagcctgaccatgttccagaacgacgatctggatctgatcgccgagaaggtcaacccggataacccgaatcaggtctggtatcgcggccagtggatcgacatgctcgtcacgcagcagcagatcaacgtgaagggtcagtcgccggtgaccctcaccctgcgtcaatcgcctcacgggccgatcgtcaacgatgcgctcggcacggccgccggtaaaaccccgattgcgatgtggtgggccttcctcgaaacgccaaacccgatcctcgaaggcttctaccagctcaaccgcgccgacaccttggccaaggctcgcgccgcagcggcgaaagtgcaggcaccggggctgaatctggtttacgccaacgccaagggtgatatcgcctggtgggcctcggcattgctgcccaagcgcccggccggggtcagaccagaattcattctcgatggcagcagcaatcaggcagacaaggacggtttctacccgttcagcgccaatccgcaggaagagaacccggcgcgcggctacatcgtttcggccaacttccagccgctgtcaccgaccggcatggagattcccggctactacaacctcgccgatcgcggtcaacagctcgatcgccagctcagcgacaagagcctgaagtggaccaacgaggccaaccagaaattgcaactgggcaccgccaccggttacggcccgcgcctgttggtgccgctattgccggtgttgcgtgaggtggtcagcgatccggcacagttgaaactggtcgagcaactggcgcagtggccgggcgactatccgctggattcggtcaatgcaacggtgttcaaccagttcctctacgacctcaccgatgcggcgatgcgtgatgagctgggcaatgatttcttcgacactttgctgtcgacgcgggtgatcgatgcggcgctgccgaggctggcggcgaatgccgattcgccgtggtgggataaccgcagcacaccgaacaaggagacccgtgccgatgttgtgcgcacggcgtggcaggcgagcatgcagcatttgaagctgaccctcggcgacaacactgccgagtggaaatggggcacggcgcacacattgacccatggccatccgttggggcagcagaagccgctggatcgaatattcaacgtcgggccgtttgcggcgccgggcagtcatgaagtgccgaacaatctgtcggcgaagatcggcccggcgccatggccggtgacttacgggccgtcgacgcggcgcttggtggattttgccgatccggcgcatgggttgacgattaacccggttgggcagagtggtgtgccgtttgatagccactatgacgatcaggctgaggcgtatgtcgacgggatgtatgtgcaggcgcatttcagtgaggaagaggtgacggcgaatacgcgcagtacgttgaagctgttgcctgcgcgggcaccttaaaagcccctcaccctagccctctcccagaggtagaggggactgaccgaggtgtcttttgtcatacatcgacctgaaagagcggtgtcgattatggattcggcacagcaatttcacgtcggcgtatctcctcaatatccccgtctcggccccctctccctctgggcggtccgacgtttcgggagggctggggtgagggtgaggtttaaagcaccaccgcaaaattcagccgaaactgctgcggcgtcacgcctaaccttcggttaaacacaccgcgcatatgctgcgcatcgcgaaacccgcactgatacgccacggtcttcaacggcgccgccgtgctttccagcatcacccgcgccgcatccacccgcgcccgctcgacaaactccgccggcgtgactttggcttcccgggcaaacactcgggagaaattgcgcgcactcatgttcgccgcattggccagatcggcaatcgtcagatcgccagtgagattggccagcacatacaactgcaccatcgccaccgccgacgtcggctctgcatgcggcgtcaggaacggactgaactgcgactggccaccagagcgctgggtgaacaccaccagtcgcttggccacgctcagcgccacttcagcgccgtgatcccgcgccagcaaatacaacgacagatcgatccccgccgtcacccccgccgaggtatagagcgcgccgtcctcgacgtacaggcgatcggcttcgacctgcgtggtcggacacaactgcgccagcgcctcggcgtcgttccagtgcgtggtgacggtgcgcccctccagcaacccggcacgcgcgagcatgaacgcgccattgcagattgaaccgtagcgctgcgcccttgaacacgccccgcgcagccaatcatcaaatgttgcgccaaaatccatgaatggcagttgcgggccgccagcgaccagcaacaggtcgtaggcctcgagggcttcgctgaagtggcgatgagcattcaggctcaaaccgttggaacaggccatcggtgttttttccaggccgatcacttccagccgatagtgatcttccggcgcgaggaagcgattggcttcggcgaacacatccatggggccggtgacgtcgagcgactgcacgcctgcgaacacaacgatggcgacggttctattcatggcagtggattccctttcaagagcaaaagatcgccgcctgcggcagctcctacaggggaatgcgggcttctgtaggagctgccgcaggcggcgatcttttagcttggcacgatttgcaggtggattggcaaggatcgcagccatgcgccgattgttcgctttcagcgtcgggaacagactttccccatcagcgccacgacggcgctttcagaaaggaaagcaccatgagcacaaccatcgccggcatcaaaatccccgacagcgccctcgcccgcgccaccaccgagtacatccgcgacatcgaatccgacctgctttttcaccattcgcgccgggtgtttttgttcggcgcgctgagcggtgagcgccagcaactggcctacgatccggagctgctttacgtcggcgcgatgttccatgacctcggtctggtcgaaggtcatcgcagcgatgacgagcgttttgaggtggacggtgctaacgcagcggcggcgtttctcaaaccgtacgggttgagcgatgacgacatcgagcaggtctggctgtcgattgccctgcacaccacgccgggcgtgcccaagcatctgcgtccaacggtggcgctggtgaccgctggtgtggaaatggacgtgctgggtatggattacgcagccttcagcaccgtgcagcgtgaggcggtggtgcatgcgcacccgcgtggggaaggtttcaaggaatgcatcatctgcgcgtttaccgatggcttgcggcatcgtccgcagaccacgtttggcaatgtgaagaccgatgtgctgaaggatcagcagccgggtttcaagccgatgaactttgtcgaggtcatccgccaatcaccctggactgcgtaaatcccattgtaggagtgagcctgctcgcgatagcggtgtttcagctgaaaaatccctggctgatacaccgctatcgcgagcaggctcactcctacatttggaattgggttgccctcgagaatgaggccaacccattagtgcttacgcggcttccgggcttggcgcccggcgcacgtccggctgcttccacgaatcggctgcgctttcttcgatggcttgctggatggctttcttgcgggcttcttcggcacggcggctgaagaaccagaccatgaaagtcacgatcgataccgccagcagaatcagactcgccacggcgttgatctccggcttcacgcccaggcgcaccgccgagaacacttccattggcagggtcgtcgaacccgggccggaaacgaagctcgccagcaccaggtcatccagcgacagcgcgaaggacatcatgccgcccgccgccagtgatggcgcgatcatcgggatggtgatcaggaagaacaccttccacggccgtgcacccagatccatcgccgcttcttcgatcgacaggtccagttcacgcaggcgggcggagactaccaccgccacatacgccgcacagaacgtcgtgtgagcgatccagatggtgacgatgccgcgttcctgcggccagccgatcatctgcgccatggccacgaacaacagcaacagcgacagaccggtgatcacttccggcatcaccaacggcgctgtcaccaggccgccgaacagcgtgcggcccttgaagcgcgtgatgcgcgtcagtacgaacgctgccagtgtgcccagcgccaccgcggcaaccgcggtgtagcaggcaatttccagcgagcgcagcaccgagcccatcagttgggtgttgtcgagcaggccgacgtaccacttgatcgaccagccgccccacaccgttaccagtttggaggcgttgaacgagtagatcaccaggatcagcatcggcaggtagatgaacaacagaccgatgaccagcatcaggctggagaaacggatgcgcttcattctttaccctccatttccttggcctgactgcggttgaacagaatgatcggcacgatcaggatcgccagcatcaccaccgccagcgcggacgccaccggccagtcacggttgttgaagaactcttgccagagcactttaccgatcatcagggtttccggaccgccgagcagttccgggatcacgaactcgccgaccaccgggatgaacaccagcatgcagccggcaatgatcccgttcttggacagcggaatggtgattttccagaagctgttgaaggtgcttgaaccaaggtcggaagcggcttccagcaagctttgatcgtgcttcaccaggttggcgtacagcggcagaatcatgaacggcagatacgagtagacgacgccgatgtataccgcgaggttggtgttgaggatctgcagcggctcgtcaatgaagcccatgctcatcaggaaaccgttgagcagaccgttgttgctgagtatgcccatccacgcgtaaacgcggatcaggatcgcggtccaggtcggcatcatgatcagcagcaccagcaccgtttgcatctctttacgggcagtggcgatggcgtaggccatcgggtagccgatcagcaggcagaggatggtgctgatcagcgccatcttcagcgagccgaggtaagcggcgatgtacaactcgtcgcccgccagcatcgcgtagttgcccaggttcagcagcagttgcagcttctgctcggcgtacgtgtagatctcggtgtacggcgggatggccacgtcggcttcggcgaagctgatcttcaggacgatgaagaacggcagcatgaagaacaggaacagccagatgaacgggaccccgatgaccagttggcggccattggggattattcggttgatgcggcgtttgaatttgcgcatgttcatgagcgaagtaccacgccgctgtcgtcttcccaccacacgtaaacctgatcaccccaggtcggacgcgcgccacggcgctcggcattggccacgaacgactgcaccagtttgccgctcggcaattcgacgtagaacaccgagtgaccgccgaggtaggcgatgtcgtggaccttgccgctcgaccagttgtattcgcaggtcggttggtcggcggtgaccagcagcttctccggacggatcgcgtaggttacggacttgtcctgcaccgaggtgctgatgccgtggccgacgtagatctgccggtcgaggtccttgcaggtgatggtcgcgtggccttcggcgtcgtcgatcacttcgccttcgaagatgttgacgttgccgatgaattcgcagaccagacggctggtcggggtttcgtagatgtcgatcgggctgccgatctgggcgatccagcccaggtgcatgatcgcgatgcgctcggccatggtcatggcctcttcctggtcgtgggtcaccatcacgcaggtcacccccacgcgctcgatgatttccaccagttccagctgcatctgcgaacgcagtttcttgtcgagtgcgcccatcggttcgtcgagcagcagcagcttcggccgcttggccagcgaacgcgccagtgccacacgctgacgctgaccaccggacagttgatgcggcttgcgcttggcgtactggctcatctgcaccagcttgagcatttcggccactcgcgcatcgacttcaaacgccggaatcttgtcctgcttgaggccgaaggcgatgttctgcgccacggtcatgtgcgggaacaaggcgtacgactggaacatcatgttgatcggtcgttcgtacggcggcatgtcggtgatgtcgacgccgtcgaggaaaatgcgcccctccgtgggccgttcgaaccctgccagcatccgcagcagagtggatttgcccgatcccgaaccgccgagcaaggcgaaaatctcgcctttcttgatttccagggacacatcgtccacggcaatcgtctcgtcgaacttcttcgtgacccggtcgatcttgaccaacacctgtttcggtgtctggtcgccctcgagggctttcttataggcgccggaggcaactgccatttacgaaactcccagataaaaacaatgcagtccgccccgcaaggcgaacccaggatagtgtgtgccttacatccccgacttgaccttggtccagctgcgggtcatcagacgctgaatgttcggtggcaactcggtcgacacataagccttgtcgataacagcctgcggcggatacaccgacgcatcggtgcggatggattgttccatcaacttgtccgaacccgggttggggttggcataaccgacgtaatcactgacctgagcgatcacctcaggtttcagcagatagttgatgaaggcgtgggcctccttcacgttcgacgaatccttcggaatcgccagcatgtcgaaccacaatgcgccgccctctttcggcaccgtgtaggcgatgttcacgcccttcttggcttcggctgcgcggttcttcgcctggaagatatcgccggagaaaccgatggctacgcagatgtcgccgttggccagatcaccgatgtatttcgaggaatggaagtaggtcacgtaaggacgcaccgcgagcaacttgtcagtggccttttcgtagtcctcggggttggtgctgttggcattcaggcccagatagttgagcacggtcggcatcatttcatccgctgaatcgaggaatgccacgccacagctttgcagcttcttgatgttctcgggctcgaacaaaacgccccacgaatcgatcttgtcgacacccagcacagccttcactttatcgacgttgtaaccgatgccgttggtaccccacaggtacggtacggcgtacaggttgcccggatcgttctgctccagacgcttgagcagcgccgggtcgagattggaataattgggcagctgcgagcggtcgagcttctggaacgcgcccgccttgatctgcttgccgaggaagtggttcgacggcacgaccacgtcgtaaccggtacgcccggccagcaacttgccttcaagggtttcattggaatcaaagacgtcatagaccggtttgattccggtggctttctggaagtccgccagggtcgtctcgccgatgtaatcggaccagttataaatatgcaccgtaccggcggcttgggctccgacagcaatcgtcaggccggcagtggccagcagggctttgcgcaaagaagaaaaaataggcaagtggaggtcctctaaattagttgggcccaagttgccccgcgctgcatgacagccatggctgcccggcaacaaaaccggcgcgcaacttaccctcgaaaaaccgttccagcaaaactttctgtcatttaattgtcccgctggccatcgtcacggagacgatggccagcggttgcggcttcaaacggcttatttgccggatttgatcttggtccaactgcgagtgatcagacgcaaggtcgctgcatcctgatcgctgatcgcatacagctgtttcttcacttccgccgaagggtaaatgctcggatcgctggtgatgtctttgtccaccaatggcgttgccgccttgttgccgttcgggaaacgtacggcgttggtgatctcggccatcacttccggctgcagcagatagttcatgaacttgtaagcggcttcgacgttttcggcatccttgggaatggcgaccatgtcatagaacgtaccggcaccttccttcggaatggtgtaagccagtttgaccttgtcaccggcctccttggcgcgggtcttggactgttccaggtcacccgaataaccgacggcgacgcagatgttgccgttggccagatcggagatgtatttggacgagtggaaatacgcaaccgatgggcgaaccttgaggaacaggtcttcggcggctttcagatcagccttgtccttgctgttggtcggcttgcccaggtagtgcaaggccgccggaatcatttcggtcggagcgtcgaggaagctcacgccgcagcttttgagtttttcgatattctcgggtttgaacacgatgtcccaggaatcgatcttgtcgatgcccagtgcagccttgaccttctccgggttgtagccaatgccgatcgagccccacatgtacgggaaggcgtgtttgttgccttggtcgctggcatcgccaaccgctttgagcaggtcttcgtcgaggttcttccagttcggcaacttggacttgtccagttcctgatacacgccagccttgatctgcttggccaggaagttgttggaaggcaccaccacgtcatacccggatttgcccgccagcagtttggcttcgagggtttcgttgctgtcgaaaacgtcgtagacgactttgatgcccgactctttctcgaacttggccacggtgtccggagcgatgtagtccgaccagttgtagacgtgcaacaccttgtcgtccgcctgaaccgcacccgccatcatgcccgccacggacagcgcgagaagtgtcttgccagcaagctttttgcctaatgccttcatgcgtaatgctccaaattttctttttttgaaccactttgttcagcggccgaacccgggcaactggaaccgcggctagtctggcaagatccggggcggtctttcaagaaaagaccagcctttctgacagctttgagcgagagcgccgcagctccctcgctcagagcctagcacttagccctgcaacgcactgagggtcagatccaggcatttgcgtgcctttgtaaccagctcatcgatctccgctttgctgatcaccagcggcggcgcgatgatcatggtgtcgcccacagcgcgcatgatcaggccgttgtcgaaacagaactggcggcagatcatgccgacgcccttgccttcgtaacgcttgcgcgtggccttgtcctgcaccagctcgatcgcgcccaacagaccgaccccgcgaacttcacccaccaacgggtgatcgttcagttcccgcagacgtttctgcaaatacggtgccgtttcgttgtgcgcgttctcgataattttttcgtcgcgcagaatgcggatgttttccagacccaccgctgcagccaccgggtgaccggagtaggtgaagccgtggttgaaatcgccgccctcgttgagcaccgcaacaacggtgtcgcgcacgatcaggccacccatcgggatgtaaccggaggtcaggcctttggcgatggtcatcatgtcgggtttgaggtcgtagaaatcgctaccgaaccactcaccggtacggccgaaaccgcagatcacttcgtccgccacgaacaggatgtcgtacttggcgaggatttccttgatgcgcggccagtaggtgtctggcggaatgatcacgccgccggcgccctggatcggctcggcaataaaggcaccgacgttgtccacgccgacttcgagaatcttttcttccagctgattggctgcccagatgccgaattcttccggggacatgtcgccgccttcagcgaaccagtacggctgcgcgatgtggacgatgcccgggatcggcaggtcgccttgttcgtgcatatacgtcatgccaccgaggctcgcgccggccacggtcgaaccgtgataaccgttcttgcggctgatgatgacttttttgttcggctggcccttgatcgcccagtagtggcgaaccatgcgcagcatggtgtcgttgccttcggagccggaaccggtgaagaacacgtggttcatgccttctggcgcgacgtcggcaatcgacttggccagttccagcgccggcgggtgcgcggtctggaagaacaggttgtagtacggcagttcgcgcatctgtttggcggccgcgtcggccagctcatcgcgaccataaccgatggccacacaccacagaccggccatgccgtcgagaatcttgttgccttcgctgtcccacaggtaaacgcccttggcgttggtgatgatccgcgggcctttctctttcagctgcttgaagtcgctgaacggggccaggtggtgatcattgctgagtgcttgccactcgcgggtttgcgggttgttgctggtcatgccaattctccttgttatcggtgaaggcgcggctttttgagggccgcgcctggcgtatcagacggcgaagagcaggtactcacgctcccaggaactgatcacgcgcttgaagttttcatgctcggcccgttttaccgcgacgtagccagtgatgaaggttttgcccaggtacttctcgatggtcgcgctgttttccatgcgctccagcgcatcttcgatggtcaacggcaggcgcaggttgcggcgttcataaccacggcccaccaccggcgcgctcgggttgaggccttcgaccatgccgatgtaaccgcagagcaggctcgcggcgatcgccaggtaggggttagcgtcagcgcccggcaggcggttctcgacacggcggttctgcgggccggcatccggtacacgcaggcccacggtgcggttttcttcgccccactcgacgttcaccggtgccgaggtgtccggcaggaagcggcggaacgagttgacgttcggcgcgaacaacggcaacagctcaggaatcagcttctgcaggccaccgatgtggtgcaggaacagctggctcatggtgccgtcttcattagagaaaacgtttttgccggtctcgatgtcgatgatgctctggtgcaagtgcatcgcactgcccggctcgccggtcatcggcttggccataaaggtcgcggccacgtcgtgcttgagcgcggcttcgcgcatggtgcgtttgaacaccagaatctggtcggccagcgacagtgcatcgccgtgacggaagttgatttccatctgcgccgtgccgtcttcgtggatcagcgtgtcgaggtccagttcctgcagttcgcaccagtcgtagacgtcttcgaacagcggatcgaattcgttcgccgcttcaatcgagaacgactgacgaccgatttccggacggcccgagcggccaatcggcggctgcaacggatagtcagggtcgtcgctgcgcttggtcaggtagaactccatttccggcgccacgatcggctgccagcctttgtcggcatagagtttgaggactttcttgaggacgttgcgcggcgacagctcgatcgggttgccttgcttgtcgtaggtgtcgtggatcacttgcgcagtcggctcaatggcccacggcaccatgtacacggcgttctggtcggggcggcagatcatgtcgatgtcggccgggtcgagcagttcgtaatagatgtcgtcttcgacgtagtcgccggtcacggtctgcaacagcacgctctcgggcaggcgcatgcctttttcggcgatgaacttgttggtcggcgagatcttgccccgggtgatcccggtcaagtcggcgatcatgcattcgacttctgtgatcttgtggtctttcaaccaatcggtgagctggtcgaggttgttactcataaatgcctctgggctgtgtctcctgacaggatgtcaggcaaagtttgacgctttgagcgtcgcgttaaaggggggtttgctcgcgcagtaccggcttacgcctggcaccgcgcatagacaatgaaagaggagcttacctgccctttacgctggcgttgcatttcctgtgcacagtccaggcgtgcagaatcacgagcacggctgggcaagcggcacaggctttgggagtgaaagcgatctatattggaaggggacgccataaacaggatgctttcccgtacgtccagaatatcggacgctggcgcttgaacggccatggacgggaacatcgtcggcaactggcaagccatgctggctgcgctacggacggatttgtcgccactgatgtgataagcatgcagaccggactgttgcgagcaggcggtgatgccgattaacggcaggcgagacatgaagcaccccggtattattgctgttatgggtttgatcggagcttagccttgttcatttttttacacaacacccccgtaaaaaatacaacacggcctgctcaagcccgcgggtgcacagtcttccaaggacaaaaaaacgcccgaaagtgccccataaatgccctcgcagcgcttttttagggcaaaaaaggcctcgcttgacttcggcaggccgttcgggttgactgaaaccagaaaagatcaatgattgatatttttaacaacaaaggtgttgcatcatgtcggtacccccgcgtgccgttcagcttaacgaagcgaacgcgttccttaaggaacatcctgaggttctgtacgttgaccttctgattgcggatatgaatggtgtggtgcgcggcaagcgcattgaacgcaccagcctccacaaggtttacgagaaaggcatcaacctgccggcctctctatttgctctggatatcaatggctctacggtggaaagcaccggcctgggcctggacatcggcgacgccgatcgtatctgctatcccatccccgataccctgtgcaacgagccatggcagaagcgcccgaccgcgcaactgttgatgaccatgcacgaactcgaaggcgacccattcttcgccgatccgcgcgaagtgctccgtcaagttgttgcaaagtttgacgagctgggcctgaccatctgcgcggccttcgaacttgagttctacctgatcgaccaggaaaacgtgaacggccgtccgcagccgccacgctcgccaatctccggtaaacgcccgcactcgactcaggtctatctcatcgacgacctcgacgaatacgtcgactgcctccaggacattctggaaggcgcgaaagagcaaggcatcccggccgacgccatcgtcaaggaaagtgccccggcgcagttcgaagtgaacctgcaccacgtcgctgacccgatcaaggcgtgcgactacgcggtactgctcaagcgtctgatcaagaacatcgcttacgaccatgagatggacaccaccttcatggccaagccgtacccgggccaggcaggtaatggtctgcacgtacacatttcgattctggataaagaaggcaaaaacatttttgccagcgaggatcccgagcagaacgccgcgctgcgtcacgcgatcggcggtgtgctcgagaccctgcccgcgcagatggctttcctctgcccgaacgttaactcctaccgtcgtttcggcgcacagttctacgtgccgaactcgccgtgctggggcctggacaaccgcaccgtggcgattcgcgtaccgaccggctcgtccgatgccgtgcgtatcgaacaccgcgtggccggtgccgatgccaacccgtacctgctgatggcttcggtactggccggcgtgcaccacggtctgaccaacaagatcgagccgggcgcgcctgtcgaaggcaacagctacgagcagaacgagcaaagcctgccaaacaacctgcgcgatgctttgcgcgagctggacgacagcgaggtgatggccaagtacatcgatccgaagtacatcgatatcttcgtcgcctgcaaggaaagcgagctggaggagtttgaacactccatctccgaccttgagtacaactggtatttgcataccgtttaagcggattgcgaaccagataaaaacgccgtcggctgtcatagcccacggcgttttttttatggccgaacacaaattcctgggattggggtgaatggccgcctgcggcggttcgcgagcaggctcgctcccacagggatctccattcaacatgagtagtgcgtacacaggagatcacctgtgggagcgagcctgctcgcgaaagcggtcgacaagacaacacaggaaccggctcgtacaatgcccgctgccccgcaggagacttccatgacgcgtcccgcccccgtccgcaaaccccgtgcccgcagtcaggcgcgcatcgactcgatactcgacgccgcgcgtacgctgctggctgccgagggcgtggccagtctgtcgatctacagcgtcgccgagcgtgcgcagatcccgccctcctccgtgtaccacttcttcgccagcgtcccggcgttgctcgaagcactgacggcggatgtacacgccgcgttccgcgcttgcctgcaagcaccgatcgatcatgaggccctgcgtgactggcgcgatctgtcgcgactggtcgaacagcgcatgctggagatctacgatgaagacgccgccgcgcggcagttgatcctcgcgcaacacggtttgaccgaggtgacccaggctgaccgccagcatgacattgagctgggcgacctgatgcacaagctgttcgatcatcacttcgagttgccgaggctgccggaggatgtcgatgtgtttgccttggcgatggagctgggtgaccgggtttatgcgcgttcggtgcagcagcatgggcagatcacgccgcgcatggccgaggaagggatgcgggtgtttgatgcctatatcggcctgtacctgccgccgtatctgcccaagcgctgagccatgatcgttcccacgctctgcgtgggaatgcagcccgtgacgctccgcgtcactggacgcggagcgtcccttgatcgatggtcagggcaaagtgagtttcattggccggcgcgaacatcccttgttcctcgtgctgtcacaaaaatctggagttgcgaaaacaacatcgaccagcagagctggccgatgcttgtaacgatcagccgtaattaaacgactggagcacgccagtcatcggaacccgaagtaccggatacttcgtgggtccaggtgattttacggtaggtgaactgcacttcttccaggtgggtgaagtgcgagttgcctggatcctggcagttgtgcattttgttgttgatggcgacgatgatcgcgtcttccagtttggtggtgtagtagtgctcttgggtgccttgagcagaagtacggtaccactggataacgatttcgctcatgcgctcgccggaagtcagtgctgcttgcagcagtggcgaagccttgtcgtagaccttggtgatcacaactggcttgtgcacgcgctgaccggttggctgaccggattgtgggtcacgcgggatgatcacgtcgtgggtgaaagcctgaaccataacctggtcttcgtggccttcctggtaggtgttgcctacggagtcagcggtgaatgcgcctgcagtgatcaggccttgtttttcgccggtaaccgacatgtacgctggtgttgccatggggtgctctccttgcggaataatttaaggtgcccgggaggcgaaatcgcccggtgggtggctgactgttatcaaggagcgtgccaacaaatgcgccgcccttgcgggccggggtgatggcggttttttgcgggcggactggcgaaaaaaacggagagaccaaggcgaaagtgcgcaagaagttgcgcagtactgcgcaacttcttgcgcacttggctgcagaccttgtgcgacgtggctttcagcggttttatcaggcttttttacaaaacaagtgcgcaacttcttgcgcacagtggctacgcgccatcatttgggtcgaggcggctgattaaaacttttagatcaaaagatcgcagccttcggcagctcctacatttggaatgtatttttcctgtaggagttgccgaaggctgcgatcttttgatttttcaacgcgcaaatcgggacagacaatcatcaatcgaacgctgctgcgtcgcggcatacaaccccaactcatcaatggtcgcgcgctccagcgcccgctcgaaggcctgccgattggagtgctcgccataatgcgtctgcgcagcatcgccgaggttcgactgaaaaatccccgccgcgctgaccggcaggaaatcttcgtacaccagtggctccgctttcacatggccatcgcggagcaaatcctccagcgaggtctgcgcgagactacctgtcgcgagtcctttttccgtagcgaaatagcgaaaatacgccagcccttgctcacgcatgccttcgacgctgtcagggaactcgccaaagtgccgggtcatcagcgcgttgtagcgtgcggcgttgccctcgttagggaagtctcccagctcatctcgcgcggcattcagcaaacggtcatacagcgcacggcccttgggcgtcagcgccgcgccgcgttgttcgatttcgccgaagcgcgcgctgtggctgccacgggatttgttctggtcggtgaaggcgacgggctcgtccagcgccttgaagctggtctggcgcaacaggatcggacactgccggcgcggcgggccttcgatgactgctttcggcgtaatgccatgggccggcatctgtgcttgaacgatgtcgatgtcgagggtgcgcggtgtcaggtgattgatgtgcgggcctttgaaggcgaccacgtcggcgatcaagcggtgctgggcgctcagcgtctggtactgcgcagcggtgaccgttgcgctgtgatgccagcgaaaggtctccagtgcctgtaggacaaactcctcatactcgtcagtgttcaagcctccgaccgtttcggcgcgctcgatcagttgcagggcggcaggggtgaagatcgttcgcttggccaacaccgattcggcaaaggcgcgcagttcggggtcttcaatcaattcaagacgcagcaacgaggtaaacactcgaaacgggctgatctgcagcgcgtcctcatgcaccgcgcgaaatgccgtggaatgcaccggcacacccgctggcgtcaggtcgtagtaacccaccggttgcatgcccatcactgcaaacaggcgggcgagggtggccaattcgctggcggtgccgacgcgaatcgccccatggcgttccatgcccagccgttcgatttccccggtgctgtgcagttgtgcggcgatcggcggatcgcgttcgagcacgtcgcggttggtctgctcgaccagttccagcagtgcgccgtacagcggcacttcttcgcggtacatgtcggacatcgctttggagaagcgctggcggatcagatcggggctgacgaaaggctgcacggtcatgaaaaaaattcctgccacggtcacgtaaaggatgctggaaaagatcgcagccttcgccgacgtcggcaaacgaagaatcctacgaacttcattctgccaatgactgatcccgcattctgtcagtgtgcctgttgcccgagaaactgccgatacaagcgcgcagtgcttgccggatgttcgaccatcggcatgtggcccacgccttcccagacttccacctgcagattggcgatgcctttgctccagatcggcacgctgctgacgtcgatcaagcggtccttgcgcccccaaagcaagagcgccgggcatttgatgtcgaccagtttcggctccatcggcgggctggcgcgaaaatcgcggaagatctcctcgagatcatcgcgttgttgttcgtagcgctgcgcgatcgcgtccagcaccaggccgggcacccacggcggcgacgacatggtcatcgcataaaaacgccggaattcctcacgggagttgatcaggaaggggttatgcccgcgtgccagatggcgttccatgtcgctggcttcgggtgccgtaactccggccgggtcgatcaatgccaccgaggcaattcgctccgggtaggtcgctgccagccacgcggcgatgtagccgcccatcgaattgccgatgacatgcaccttctccacgccgcagacgtcgaggagttgaatcatgcgcttggcctgcaacggaatgtcgtagccgccgccagccttgaagccggtttcaccgtggccggcgaggtccgggatgatcacccgatactggcgcacaaagtgccgggaaaagcgcagccacaggttcttgtcggcgctgtagccatgcagcatcagaatcgcgctggccgcttcgtacggccctccttgccaggtcgagacggtcatctcggcgatcggcacttcgatcttgtgcaatttgtacaacttggcctcgatggccatgttcaggtcgtacagccaatgaccgaccgccggataactcaaccagctccaggccacgaaaaccgcgagggcgacaaacagcaaaagcatcgacgtcttccttttacgtgttcaggacagaatgtggtcggccggtttcagcgcccgggtcaagcggtgatagctgaaactgaagccgggaaacatcgcgatcacatgaccgctcttgctttgataccaactgtggcaaccgccggacttccataccgtgcgctccatctcccgatgaatcatctcagtgtaggtacgttccgcttcggggcgcacttcgatgctgcgcaggcccttggcctgcacggtgcgaatgcagtcgaggatgtagttcatctgcgactcgatgatgaacagcgccgaggtgtggccaatgccggtgttagggccggtgacgataaacaggttggggaagtccggcaggctggtgccgagatacgcgcgcgggtattgcgcccagacctctctgagttgcacggcgttttttccgctgaccgggtaggaaatcaccccgtcggtggcgtcataaccggtcgaccagacgatcagatcaacatcgatgtgctgaccgtcctcggtgttgattccggtttcgtcgatggaagcgatgccttgctcgcgggtatgcaaggtgacattgggacggttcagcgccgggtaataggtgctggaaaccagcacccgtttgcagccaatggtgaagtccggggtgagtttttcttgcagcaccgggtccggcacctggcgttttagaaagcgcagggcgtgctgctggaccatgtgaatcgccgctttcgagtatttgaacgcgatgacccgggtttcgaattgccagtaaatcagccagcgcaacagtttgtaggcgggtttcaggccgagcagccagcgttgcagcggcccgaactgacgatcggcgcggggcagcacccagtgtggcgtgcgctgaaacacgtgtaggtgatcgacttgcggcgcaatcgccggaatcacctgcacggcactggcgccgctgccgacaatcgccacatgtttaccgcggtagtcgtagctgtgatcccaattgtttgtatgaaaagtcttgccttgaaagcgatcctggccgggaaagtgcgggatgaccggttggctcaatggcccagtggcattgatcaggaactgcgcataaaaggtgcctttgctggcggtgtgcacgttccagcgtttttccgtgtcgtcccattcgatgcgctcgacattggcttgcagctccacacgttggcgcagcccgaattgctcgatgacatgctcggtgtagcggtgcagttcggcctgcccggcgaacatctgcgaccagcggtacggcgcaaacgacagcgaatacagcggcgacggcacgtccaccgccgcgccggggtaggtgttctggcaccaggtgccgccaaagaagtcccgccgctccagaaggcgaaaatcatcgatcccggccttgagcaggttgaccgcagcacattgaccgccaaaaccgctgccgatgatcaacacgtgataggtgtgcatgggcctccttcttatagttgtttttccattttgctcctttcatgtatagccaaatatttgcactgcgtgcggccctgatgtcgctctattcagcccgctggccggtgatggctatttaacgtcgccctgttagacttccagcacatccgtcctgcggtgtgcgtgatcgaggtccttatgggaaataccggaggaaagggactttcattggccaggaggctttatacatcgcgcatcctcgggttgattctcgggctcgtgtgcgtgagcgtggcgatgtactcgctcgatccgccgctgtgggtctgggcgttgatgttcttcaacggcctggtctggccgcatctggcgtttcaatgggcacgccgcgcccgggttccttaccacgctgaacaccgcaatctgttgatcgatgcctttttcggcggcttttggcttgccgccatgcatttcaatccgctgcccactgccacgaccatttcaatgatggcgatgaacaacgtcgcaatcggtggttcacgctttctattggcaggctctgcggcgcagttgctcggggtcggcgtcgggctggtggtgtttgctccggcattcattccgcaaaccacgcctgcacaaatgtacgcctgtttcccgttactgctgctgtacccgttggcgctgggctggatctgctttcggcaggcctacaccctcggtcggcataaacgcgaattgcttgccctgagccgcactgacagcctgaccgggttgctcaatcacggcgcctggaaggatcaactggagatcgcttttcagcgttgcaagcggcagaagcagggcgcagcgattgcgttgatcgacatcgatcacttcaaggcgatcaacgacacctacggccatgttgccggcgacatcgtgttgcgccagttgagcaagttgctcaagcagaacctgcgggcgaccgatgtggcggggcgctacggtggtgatgagttctgtgtgattttgccggatctgccactgttcaacgccgcgcagaccatggaggcattgcgcgagcgtttcgcgattctgggttatgagcagaatccggcgttgaaggtcagtttgagtattggcctggcggcgtacgatccggcgcatgccgacgcgacacgctggctcaatgatgccgatcaggcgttgtacgaggccaaggcgagcgggcgcaaccgggtgatctgcaattgcgatggcaagccccggcggacgttgctggattcggtttgagccctgaccacaatcccccgtaggagtgagcctgctcgcgatagcattgtgtcagtcaccatcaatgtcactgacagagtgctatcgcgagcaggctcactcctacaaatttgttcggtgtcgatctggaggaggtcgcattcggtgtagagccgcgcgccgatgtcgggtacggttaaatccccccgacgcgaaacaaggatcgcttcatgacgtgctcattttctcgctccctgctggccgccagcctcggcctgtctctcgctttctccgctactcatgccctcgccgaaccgcacaaacaagtgctcgctgatgccgaacaataccagccagaagccctgaagctgctggaacggctggtcaatatcgactccggttctggctatgagcccggcctcaaacaagtcagcgacatcgctatcgatgagttgaaaaaactcggcgccaccattgaacgggtgcccaacacgccggaaaaatccaaccatgtactcgcgacgttcaaaggcaccggcaaggcgaaaatcctgctgatggcgcacatggacacggtgttcaaggaaggttcggcggccgagcggccgtttcacatcaaggatggtcgtgcttacgggccgggggtgatggatgacaagggcggcatcgtcgccgggatctatgcgctgaaagtcctgaaaaacctcgacttcaaggactacgcgcaaatcaccttcctgctcgacgccagtgaagaaaccggctcggacgtcgccaccgacctgatcaagaaaaccgccaaacagcacgacgtgacgctcaatctggagccggggcgcccggccgatggtttggtggtgtggcgcaagggcagcgcgacggcgctggtcgaggtcaagggtaaagccgcacacgcgggcgttgcgccggagttggggcgcaacgccgcgatggaggcggcgcatcagattctgcaactgggcaaactcggcgacgaggcgaaaaaaaccacgatcaatttcaccgtgctcaaggccggcgaccgcaccaacgtgattcccgatcaagccacggccaaggccgacgtgcgcgcggcggtgccggaggagtttgaccggatcgagaaggatctggcgcgggtctcgcaggacaaattgattgctgagacggaagtgaagacttcgttgcagcgcggcttgccgccgatgccgcagacgcccgagtcggatcgcctgatggccatggctcaggggatctacggcgagattggccgcaagttgaccgaggagggcagtgggggcgcggcggatgcgagtttgtctgccggggttggcacgccgacgctggatggcttcgggattgtgggcggcaatattcatacgccggaggaatacgctgaagtggcgagcgtggcaccgcggatttatttgttgtcgcggatgattatggagttggccaaaccgcggtgaggtagcgatcgttcccacgctctgcgtgggaatgcctcaacggacgctcggcgttcgctttgtgtgggacgcagagcgtcccgggctgcattcccacgcggagcgtgggaacgatcattaagccgcggtgaggtggtttgcggtgtgatgaggtcggcggggtgccagataaatcggcccctcaccctaaccctcccgaaacgtcggaccgcccagagggagggctagggtgaggggcttttgtgaaaagtggaaggcgcgggcggcgcacaactttccaagacgtttcctacaacgtaccctgttgccgcgtttcggtatcgacccctatagttcggtgctcttcctcaacacccactcagaactcagcgacatggccgcctgtgcgatgcaccagtttgcggtcgtgcgcgatctggccgacaccttcgccagtctcaacctcaagggcatttccgattgtgatctgacgcgggtgaccagcgcggtgcatctgctgatgcgcgagggctgtgcgattctgaatgtgattcaggcgcgggcggtgcagcgggaagaggcttacaagacgccggtttagcggtgtagcggctgttgctatcgcgagcaggctcactcctacagtagatcttcagtgcacacagtatttgtgttcagcactgatcaattgtaggagtgagcctgctcgcgatggcgtcagcccggccaatccatcactccttgacgctcatgtattccttggcccagagaatgtattcctccggttgggtataggtgtgcgtcaactcggtcgcgctcaggtccgaagcctgggtaaaaatctgccgctgttcgcgcaggctgtcgtacgtcgctttgatcgccgcaaaataagcgccatggccatcaatggtcacgcgtacaccgagttcggccagacgtttgtcatcgcgcaacgccgggttgccgtaggtcaccagcatcaacggtacggtcaggtgttcggcgatttgttccaactgatcaaaatcctgaatcccgaccatgcagatgccgtcagccccggccgcctgatactggcgagtgcggctgatgatttcctggttcggcagaatgccggcgttggtccgggcaatgatcgccatttccgtatcgacccgggcttccagcgctgcgcggatcttgccgacaccttcggcgacggtgatcaggtcggtggatttgcgcccgaactgggcaggcagcaaggtgtcttcgatggtcagggcggcgacgccggcgcgttccagttcgacgatggtacgcatcacattgagggcgttgccgtaaccgtggtcggcgtcggcaatcaccggcagttgggcgacgcggccgatgcgggtggcctgttcggcgaactcgctcagggtgatcaaggcaaagtccggtgcgcccagcacctgcaacgaagcgacggaaccgcccagaattcccacttcaaaacccaggtcagcggcaatgcgggcggacatcgggtcgaacaccgaagcggtgtgatagcaggtgtcggaggccagcagctgacggaaactacggcgcaaatcttgatgagaaagcctggtcatacgagttccaccaatacaaaggaatggaaaggcttgagcaaatgtgtcaacgccgaagaatgaaaaggctatcacgcgaatgggtcaaggatcatgacgaatttgcaaggctgacgtttgccgatgagcgctttgctgaaaggattaatctgatcgggcgaaatttggccgtattgagggggcaggtaacagcttgactgcatggattgaggcggggcggcggttcaggccgccaccgcctgtcgctgttgattgggcagcatcaccgcgcgcaccgaattgcccggctgaagttgcagacgttgggcggtcatgcggtcgatcgccaggctgctgccgactcgacgggcgcgggcgacggtgatgcggcagttttccaggcgacggttgtgaatcagccacagcggcgccaggtcgtccggggtgccgaggctcagggtcagttcgaggctgtcacgcacggtacggatgttgcgcagcggcgcctcaatgaccgggccgccatcaaaaatgtcgatataacctttgtgggcaaagccttcggcctgaaggattttcagtgccggctcggtattcggatgcgcctgcccgatggcggcctgtgcctgtgcggtgagcaggcaggtgtagaggggctgacgcggcatcaattcggcgatgaacgccttgttgcccagccctgacagatgatcggcatggctgaagtccatctggaaaaagtgccggccgaggctgtcccaaaatggcgaacaacctttttcatcggcactgccacgcagttcggcgatcatcttctcgccaaacaggtgcgggaactcggcggcgaacagcaagcgcccgagtgacagcagacggccgttgctgccggtgcgttgatcgtggcgcaagaacaatgagcacagttccgattgcccggtcagttcgttattgaggaacaacgtcgggatctgccgttgaatacccagatccggcgccgaactcaccgtcagtccgacccgatagttgtaccagggttcgcgcaagccaaccgcgccggccaacgcgctgacgccaaccacgcgcgtatcgtcgtcttcgaggacgaacagataatcggcatcggcgcgctccacttgctcggcgaacgctcgttgcgcccagcgcacgcggtgggccaggcgatcttcgttggccggcagggtggtgaatcccgggccggcttgttgaaccagtgtcatcaatgcaggcaggtcgctgacgttgaccgggcgaacaatcatgctgtaactccttctgcgcgcctgttcgggcacgctcgttggctgcggaaccgggcgcggttcaaagggcaatcagccgtatctggctgccatcggttacgttcagcgccgcacacattgcaggagtgagggacagcggttgatcgggttggtaatccagttcggcaacgatggcccggtagccacgccacgcgtcgttgctcaacagatagcggccacgcgcatcgatttctggcaactgctgcaccggggccgtctggctgcgggcaatcgaacggatattcgcggtgcgcgcatacagggtcgggccagcatcgaacaggtcgatgtagctgttggtttcaaaaccttcgcgctcaaggatgtcgaacgcctcttgcccatccgggtgaatgcgcccgatacactcctgcgccgcctgcggcagcatcggtacgtaaatcgggtattgcggcatcagttcggcgaggaatgagcggctctgcaacccgcacaggcgctcggcctcaacgtacggcaggtcgaagaagtgcttgcccagcgcatcccagaacggtgaatggccgtgttcatcgctgtacccgacgatttcggtaatcaccgcttcggcaaaacagggcgcatgggcggcaatgaacaacaggcgcgcccgcgaaagcaattccgagaacggcgtgcggaccagcgctttgtcgatgtgaaaaccgcgcagcagcgtatggtcgttgaggtcatggcacagcgacaatgccggcacaccgtgttcgatgttcagctcgcgcgaggcactggtgaaatggcgattgcgcaggctgtagaacggctctttaaaacctgccttggcaagaatttccgagcaaccgaccagacgctgcgtgttgcaatcttgcagcacgaaaaaatagttttccggcccctgcgtccgtgccgcgctgtcgaacgaggcgcaggacgcggcgattttgtcgcacaggcgctcgctgtcatccggcagcgaggtcactccgaccatgctgtcgcgggccagttgttgcaattgcggcaggtcggttggctcgactgggcgtaagaccagcatggatgcactcctgtatcaaagggttcggcgaattcacgaacctgactatcactgtcggtttccacgcgttaaatcggcggtcgcctgatttgttgtcagacgccgctctttttcttgtcagccattgctcgggtcaggcaacgcggtactggcgccgagcttgttgagaaagaacaggtacaccaggcccagaacgatccagatcaggccgagtttctgcgcatcgacgcccatgttgtacatgatggccgcaacgatgatgaagccgatcaccgggcagatcaggtgacgcacaacctgaccggacttttgccgacgccagtagtagttgatcacggtcaggtgcagcagcatgaaaccgctgagtgcgccgaagttgaccagcgacgtcagggtgtcgaccgagttgatgaacaggtagcagatcaccagtgacagcaccgccaccagataaatgctcaggtacggcgtgttgtgtttcgggtgcaccttggccagcattttcggcagtttgccgtcgcgggccatgccgaacagcagacgcgagaccgcggcttgcgaagtgatcgccacggccacaccccaggcgagtgcagtcgcgacagccgtcagagtcgccagccaactgccggcggcgatttcggcgatttcatagaacgcagtgtcagcggatttgaagcccataccggctgccagatcgctggcgatccaggtttgtgcaacgaaaatcacgcccatcactaccagagtgatcaacgccgctttgccgacgcttttgcccggatcacccttgatttcttcagcgagcgtcgagatcgcatcgaagccgaggaacgacagcaccgcaatcgacaccgcttgcatcagcagggcgaagttgaaggtttccgggtgatacagcggcgccagggtcagctcgccgttaccctcgccgttgtgcagggcgttccaggcatagaacaggaagatccccagtaccaccagttgcgcgagcaggaagatgatgttcatccgtgcggtgaaggtgatgccgcgcaggttgacgaacgtggcgctgaccaggaacgccagaatgaagccgaccttcggaatgtccggatacaaatggttgagcgccatggctgcgtacacataaagcaacggcggaatcagcaggtaatcgagcagcatcagccagccggcgatgaaaccgacgtgttgattcaggccgcgctgtgcgtaggaatacaccgagccggcaatcggaaaggcgcgggccatgctgccgtagctcaacgcggtaaacagcattgccatcatgccaatgatgtacgccagcggcaccattcccggtgcctcggcattgacgtagccatacacaccgaacggggcgatggggatcatgaagatcatcccgtacaccaccagatcggtgagcgtcaggctacgtttcaactcttgcttgtagccgaattcttcaatttccatgaagcgcaactccttgtcagccaatcggttgttttagttgttatgtcggtccatcgtttacagcgtcagcattcgatacggcagtgattacagcaatggcgcaaggtatccggcccagagcgataccgcttgcgggctacgcagcaaatcgttgcgtacctccaccagcaccgagtccaggcctcgggcgtcgccgtgcaccggtaccgtcatgtcgcccaacgggtcgatcttgtacggctgattgccggccacttgcaacgaatgttcgccgagaccgttgagcagccgttgcgcgtacgccttcgcctgaccgaacagcacgccgatctccagtgttcgcggctggccgtaatacaccggggtgaaactgtgaatccctactacgcgcaccgcttgacctttggcgaggcgttcgtcgatcagagtctgcaagcgcgcatggaacggcttgaacagcgtctgacggcggtactcgcgagtggcttcatccagctcgcggttgcccggtatctgatagatctcgctctgcgccggaatgctgtcgggcgcatgccgtgggcggttcaggtcgatcagcagtcgcgaataattggcgctcaacaatgttgcgccgagtttttccgccaactgttcggccagttgcagcgcgccgatgtcccaggcgatgtgttcaccagcggcggtatcatcaaggcccagattatcgagggcttcggggatgtagcgactggcgtgttcgcacacgagaatcaacggattcgtcgaatcctcgcggctcaggtggtagaccggtcgggtgtacaacccaagctcggcggattcagtacaggcgtgcatagtgctcacacaggtcagcgggcgagagctgttccgtcagcgccagttcctcggttttaagggcgtgataggtatcgagcaacggtttgggcagccattcgttgaaggcgccactgttgcgcaggcaatccagtgcctgggccagcgaggcgggcagggcgacaatgccccgagccttgcgttgctcgtcgttgagtgaatcgggaacttcatcggtgatggcgttaagagccaggcgctgttcgatgccaaggcgtccggcgatcagcagtgcggccatggccagatgcggcgaggccgtggcatccatggcgcggaactcaaggttgaactgcgtcgccaccgatttgccgcccagggtcaccgtcgggcagatgcgcagcgccgcctcacggttctgttgacccaggcacgcgtaagacgcgctccagtggtgcggctgcaagcgctcgtacgacactggcgttggcgcagtgaacgcgcacagcgccggcaagtaatggaggactccggcggcccagtgctggccgaggctcgacaggccattgctggtgccagcgtcgtaaagcatcggctgcccgcccggatcgagcaggctgacgtgcaagtgcacgccgttgcacacggcatcggcggcggtcttcggcgcgaaactgagttcgagccccatctgtcgggcgatctcgcgggtgatttcgcgcacgttgaccgctcggtcggcagcggctacgccgagggtcggccggcaggtgatttcgtattggtgcttgccgtattcggggaggaacatttccggttcgacaccgccggcgcgcagagcgctgagcaaccagccgccgaacgctgcgccttggcgctgagcctgcagcgaaaacgccaggtgctcggcaacacctgcgtgcaggttgaattcgtgttcgaacgcggcgttgacctgtaaacccagttcgtcgcgatagcgttcgacttcatcgcgcagcagcgtgcgtggacaggcgccccacggccggccatcggtttcacgaatatcaccgtggatgaagtccagcgccggtgcgtcggcatccggaccgttggcgacggtgacgcggctggccagatccggaatcaggcgcagatcgccataagcgccccacggattggtcgaggcaatgatgtcttgcggggtcaacgcgctgttggccggcacccagccacaaccggccgcctgataatgctcaagttcatcggtgggaaacgagcgcccccgagtgataccgatcaggtcagtggtgacgatggtggtcatcggcacagccgccaggcgcgaagtcacggctgcatctcccgcaaacggccgagcacggtattggtgtcggtgatccagcaataacccttgatcgcattgaggcaggcgtgatgacgttcggcgctgtaagtggcacaggcgtcttcgaccagagtcaccagataaccacgatcggcagcgtcgcgcacggccatgtcgacgcactggtcggtgacgataccggcgatgatcaggtgacgggtttgaaggttgcgcagcacgtagtcgatggcggtcgagttgaacacgccggacgaggttttcggcaagacgatttcgttgtcgcccggggtcagttcgccgatcacttgtgcctgcggactgcccttgggcaggtgcatgtccgaaagtttatggtccagcgagcgatcgcgaccgtcggccgtcaggctttcgatcagagtgtgcagcacattttgcctggcctcgcgaaaggcgctgagcaaccgttgctggttgggcaccacctgcgtgcgtgcgcggttgaggaaatactcggcgtccggctcactgaggtgtggatcgaactgcggttcgagccaggcgcgctgcatgtccaccaacagcaatgcagtgtggtcggtgacaaacggcaagtcccgcggcgagcggtggggaaggctgaacatccttatttttcctccagcaggtgagtggcgaagtcgttgcgcagggcatcgatgccctcgaggcgatcggccagatccgggctgcgcagggtcaggcaggcaatcagcgcttcgacctgtgccagcgccgggaccatggtgtcgaacggcgaggccgattcgaccggagcgctaatgatcaggtcggccatttcgcgcagtggtgaggcataaatgtcggtgaacagaaccacgcgggcattgttgttttttgccgctgtggcgacacgcagtgcctgggtctgatagcggcggtaatcgaataccagaacgacgtcctggcgctgcagatcgaacaggcggtcgggcaacagcgcgttgtcttccagggcaaagcagccggggcgcagcagacgcaaatgattgagcaggtaagtcgccatcaggctgctgaagcggccaccgaagcagtacacctgatgtcgggcatcgagcagccagtcggtgaggattcgcacgtcttcgggctgggtcagcgattgcgtgtcgaccagcaggcgatggctgtcagcgaggtaatgagcccaggcgtcgtctttgttttgctgcgcgcgcggttgcaacagcgtgcgcggcgagcgcaggcgatggtccatgtcgctgagcagggcgtcctggaattcggcataaccgccgaaaccgagttttttcaccagacgcacgatggtcgggtcgctgacgccggcatgctcggccaggcgcgccatcggtccaagaccattgcgcggatactgatcgagcaaggcgcgaacgactttgcgctccgatggcgtgagttccaggccgggatcggtgatcaggtctctgagagggggcatccgggctcctgctggatggggggtgtcgaattcgcttcataatccgttaaaacagtatttatgtaactcacgctacatgtctagcgaatttttcgtcgtgtttaaaaggctccaaaatggcgcaggatgcccgcgtcataagggctacacggaagtcgacaggtgttgtagtccattgcccatagctatgtcagatatcgccgcttttctaacatccagagttcgcccggaaacgtatcgatccccccggcaaccgttggtttacggcacaattgccttcaatccggctctacgccgttgatgtttctgatcctcggcagagtgagcccatcgtgcagaccacccgcttgacactgatttgccacgcacgaaccgtcgcacagaaattggcgtgttttcctccgaacgagcccgttgaagatgttgctctgacgcctggctcaatggctgctcgcttcaatgcggcgcgacgtttgctctgcggtcccgaactgcgcacccggcagacagccgcctggttcggggcggatgctcgggttgacgaggcattgcgcgattgcgactggggaaattggcacgggcgatcaatcaaggacctgcaaacgacgcaagcgcaggctttgcaagcgtggctgagagatccgcatgcagcgccccccggcggcgaatcagtgacggatctggccacgcgagtcgcggcatggctgcaaagtttgcaaacgacgccggggcatgtggtggcgatcacccacccgtacatcgtgcgtgccgtgctgatgcaggtgatgcaaggcgcggcgttcaatgcaatcgacgtcgaaccgctgtcagtcatcgagttgcgcttcaacgggatctggcggctacgcttgccgggcatcgacatcgaaggagcatgctaatgaaacaactgctggtgatcggcatcggtgccggtaatccggactacatcacgatgcaggcggtcaaagcgctgaatcgggtcgatgtgttctttctgctggataaaggccagagcaaggacaaactgatcgatctgcgccgcgagatctgtgaacgctacatcagcgatcccgcctaccgtttcgccgaagccgcgagcccggagcgcgagcgcggcgatgtcgactacaacgcgagcgtcgatgaactgaactgcgccaagcaagcgaccttcgagcggctgatcaatgaagaattgtctgacggccagtgcggcggttttctggtgtggggcgacccggcgctgtacgacagcaccctgcgtatccttcaggcgattctggattcgggtcgttgtcagttcgagtttgaggtcatccccggcatcaccagcgttcaggcgctggcggcgcggcataaagtgccgttgaacagtattggccgctccgtcgagatcaccacgggccggcgtctggcggcggggcaggtgagtgctgccgacagcctggtggtgatgcttgatgccgaggattcctaccaccacgtcgccgacccgcaaactgcaatttactggggcgcgtacctgggcacggcggatgagatcctgatcagcggcaaacttggcgatgtcgccgatgagatcgagcgggtgcgcaaggctgcccgggcggagcatggctggatcatggatacctatctgttgcgcaagtcctagattttcgctggcctcatcgctggcttgccagtgctgaggcccaccagatcacctcaagacctgacaagggcgccacgcccgaaccgctcccgatacaccgacggaggcacgcccaccacgccgcgaaacgccacccgaaaactctccaccgagcgatacccgcaacgctgcgcaacctgttcggtgttgtccgtcgtgctctccagcaactcccgcgcccgcgccagtcgttcatgctgtagccacgccttgggcgactgcccgcaggcttcggtgaaacgccgcaagaacgtccgctcgctcatcgccgcttcgctggccagttcgcgcacctccagtggttcatgcaggcgttcgcgcgcccattgcatgacccgtgacaaatcgttgcgcggcgtcgggctgaccggcgtcggaataaattgcgcctgaccaccggtgcgctgcggcgacatcaccagccgccgcgccaccgtattggcaacctgagtgccaaagtcacgggccaccaggtgcaggcaggcatcgattccggcggcactgcccgccgacgtgatcagctgtcccgagtcgacgtaaagcacatcggcgtcaacagcaatcatcgggaagccttgtgccagttccgccgcgtagcgccaatgcgtggttgccgcatggccgtcgagcagaccgctggcggccagcacaaacaccccggaacagatcgacaacagtcgcgcaccccggccgtgagcctggcgcagagcatcgagcaacgcttgcggcacctcggcattgcggtcacgccaaccgggaatgatgatggtgcgtgcagtggcgagcagttccaggccgccatcggccagtacttgaatgccacccatggcgcgcatcgggccttgatcgaccgcggcaatcacgtgttcgtaccacgggaattcgaactccggccgagccagaccgaagatctccacggcaatgccgaactcgaacgtgcagaggccgtcgtaggccagaatcgcaaccagtcctggagaggcaggcatttggcggaaaactcccgatgagtgtcttgtgcgccactgtagcgattcgcgtcgtctcgataaagtctgttcattcccatcgatacgtaggagcaacacccatgccgagcctggttcgcgaaattcctgccgccccttcggcgattgcactgatgcatttcagcaatcgtctgaccttcgaaaccgattgttccgacgtgttcggcagccagcaggccggcgaggtcgattttgtgttggtggacgtgcgcggaccactggcgtttgaacgcggccatgtaccgggcgcgatcaatattcccggacggttgctgacggcagaaggtttagccagctacccgaagagcgcgctgttcgtggtctattgcgcgggcccgcactgcaacggcgccaacaaggctgcagtgaaactggcggcgctgggttatccagtcaaagagatgatcggcggcattaccggttggctggatgaaggcttcgaactcaacgtgcccaaaactgcaaacacccccatcaactgcgcctgctgatcacctgtaggagctgccgcaggctgcgatcttttgccgttgttttcaaaaaaaacaccagatcgcagccttcgcaagcccccgcatagggcttgtcctacagcctttgcaccacgacagagcagccgttgaccccggtcaatggtcgcgccgaatttttgtaagtatttgtcgcttaaacacaatttaccctgtgcgcgccgccatagactgccggccacttcggtatttgccgttaaaaggccatgaccgaacgctgaatcgaagctgccaataaaagcctccgcacacaggagttataaatgaaaaagctagtgatgttcggtgccctggcactgtcgatgttgtctctgaccgctgtggccgaagacgccaagccgatccgcatcggtatcgaagccggttatccgccattctcgatgaaaacccctgacggcaaactgaccggtttcgacgtcgatatcggcgatgcgctgtgtgagcagatgaaagtcaaatgtacttgggtcgaacaggaattcgacggtctgatcccggcgctgaaggtgaagaaaatcgacgcgatcctgtcctcgatgaccatcaccgacgatcgcaagaagaacgttgatttcaccatcaagtactaccacaccccggcgcgtttcgtgatgaaggcaggctcgggcgtgaaagaccctctgaccgagctcaagggcaagagagtcggtgtgctgcgcgccagtactcacgaccgttacgccactgaagtgctggttccagccgggatcgacctggtgcgttacggctcgcagcaggaagccaacctcgacatggtttccgggcgtatcgatgcgatgctggccgactcggtcaacctcagcgacggtttcctgaaaaccgaagctggcaaaggttttgaattcgtcggcccgacctacgaggacgccaaatacttcggtggcggcgccggcatcgcggtgcgcaagggcgataccgcgctggccgagcaattcaaccaggccatcactgaaatccgcgcgaacggcaagtacaagcaagtgcaggacaagtacttcgactttgacgtgtacggccattaatacgccgtcaaaaagtggccccgtgtaggcggaggccactttttttatgcccatgatttatcctgccccacaccttccaacgcaggagcctgcggcagctcctacagagatagcggagttttctcatgcaacgtatcgaccatgttctaccctggagccatttgggcagcgaacgctctctcagcgtgttccgttacggcgccggcgaccgcaaggtgtatatccaggccagcctgcacgccgatgagctgccaggcatgcgcaccgcatgggaactcaagcaacgccttaacgacctcgaacagcagggccgcctgcacggtgtgatcgagctggtgccggtggccaacccgatcggcatggaccagcatctgcaaggcaatcacatgggccgtttcgaaatgggcagcggcaagaacttcaaccgcgcgttcgtcgaactcagtgcgccggtcgccgctttgatcggcgcgcagttgggtgccgatgccgagaccaatgttgtcctgattcgccaggccatgggtcaggtgttcgatcaactgccggctcccgcctcgcaactggaagccctgcatcgactgctgctgcgccacgcctgcgacgccgatatcaccctcgatctgcattgtgatttcgacgctgcgatccatctttatgcgctgccgcaacattggccgcagtggcaatctctggcggcccgtctgcaggctggcgtggcgttgctgtgtgaggattccggcggcagctcgttcgatgaatcctgttcgacgccttggctgcgtctggcgcaagccttccccgctgcggcgattccgccagcgaacctcgccaccacgctggagctgggaagcatgggcgacacccgggtcgatcaggctcaggccaattgcgaggctattctcggttttctcgccgagcagggtttcatcagcggagaatggccggcggcgccgagcgaatgctgcgaaggcatgccgttcgaaggcaccgaatacctgttcgcgccgcaccacggcgtggtgagctttctgcgccgcgccggcgaatgggtggaaaagggcgatgccttgtttgaagtggttgatccgttgcaggatcgtctgaccaccgtgtacgcggggaccagtggtgtattgttcgcgattgatcgcgggcgctataccgaacccgggatctggcaggcgaaggtggcgggacgggtgccatttcgcactggcaagctgacaaacgactgatcgtcgcctggcgcgtttgccggctggttaccggcagacgacgccccttgatcgttccccctcgcgcgttatctcgccggccggcggcggtgtaggacagctgaggcattcggccagtaaaaaaaccactgaaaagcggcaaattgctggcccccgaggcgcatcttcatcggcaaaatcgccttttttcaaaaggttaggttggctatatgcggacgattgtcataaccgttgcaacgctttccctggctgttcttgcctcgggcgtccaggcaaaagagttaagcaagagtcaccggtttgcctgcatctggggttccgatatcgccgccggcgcacagcaatccaagctgtcgggcatctccctgtatggcgcgcgcaagcagttgcaggtgcgcaggtttcagcagccatggatgcgcatgacggcgatgggcatcaccgagcagacctacaacagcacttcaaagctcaagcctgcggcggtcaagcagacttactacgagcagtgcgtcaggcacgaactggcgcagcgttgaaacaccagcgaggaacccttgtcgtgtgaaattcagtgttggcgctggagtaccatgagccatctttatcacctgcagagtccattaccgcatgcctgatctaacgcgtatcacgtccttgttcgatcaggcgcagcgggccatgcggctggtctgggggacatcgcgaggcttgtttctcgggctggtactggcaacgctggttgccgggctgctgccggcactggccgcatggttggggcagcggatcgtcgatgccgtggttgcggcgatgcagttgcacgcgcaacagggcagtgcgccgctgtggcccgtgttgcgttatgtgttgttggaagccggggtgttggcgttgttatccggcacccagcgggcgctctcggtgcagcagtcgctgttgcgggtgcaactgggacagaaggtcaatacgctgattttgcagaaagcgcagaccctgtcactggtgcagttcgaaaactccgagttttacgacaaactggtgcgtgtgcgtcgcgaggcttcgacccggccactggcgctggtcatgaagtcgctgggcttgactcagaacctgatcatgctgatcagcttcggtgtgctgttggtgcatttttcgccgtgggcgctggtgttgctggtggtcggtgcattgccggtattttttgccgaggcgcatttttccggtgacgcctttcgcctgttcacccgccgggcgccggagagccggcagcagagctacatcgaaaccttgctatctcacgaaacctatatcaaagaggtcaagctgttcggctttgccccgttgttgctgcaacgctaccgcgacacgttcgccaggctgtatgccgaagatcgacgcctgacgttgcggcgtgatggttggggtttcggccttggcctgctcggaaccgcagcgttttacctggcctacgcctgggtggtgaccgatgccgtgcatggccagatcagtctcggccagatgaccatgtatctggtgctgttcaagcaaggccaaagcgcggtgagcagcagtctgagtgcgatcagcggtctctacgaggacggcctctacctgaccagtctgtatgaatacctggccgaaccggtgcaggtcgataccggtcacctgacggtcggcgtccgcccaggggatggcttgcgtttcgaaaacgtcggtttccgttatcccggagccagtcggccggcattggaaaacattgacctgcaactgttgccaggccagagcatggcgttggtcggggaaaacggttctggcaagactacgctgatcaagctgctgacccggctttaccgccccgatcaagggcgcattctgctcgacggcagcgatttgcaggaatggcaggaaaccgcgttacgtcggcgcattggcgtgatttttcaggattacatccgctaccagttcactgtcggcgaaaacatcggcgtcggcgataccctggcgttcgacgaccagcagcggtggcaggaggctgctacccaaggcatggcggcaccttttatcgaagggctcgacaagggttacgccacgcaattgggacgctggtttgccggtggccaggaattgtccggagggcagtggcagaagattgccttgtcccgcgcgtacatgcgccgtgatgcagaccttctgatcctcgatgaaccgacttcggctctcgacccggcggcggaagcggcggtgttcgagcatttcagccagcacagcgaagggcgcatgaccttgctgatctcccaccgtttttccagtgtgcgcaatgccgatcacatcatcgtgctgcaacaagggcggattctcgagcagggtggccacgatgagttgattgccactgccgggcattacgcgcaactgttcgatttgcaggcgcgcgggtaccgctaggtgtcccgcgagctgcgcacgctcgcaggcccggccacccgaggggcggttttgctctgcatcaagctgtcgagcgccttgcggtaattctgcccgccgagggccatgctgttgttgtgcgtggcgcccggcaccagcaacaggcgtttgggttgccgggcggcgttgaacaactgttcgctgaagcgcggcggcacgaacgcatcagccagaccatgcaccaccagcaaaggcatatggatgtcggcgattttgtcgatcgaatcgaatttttgcgacagcaaccagcgcaccggcaaggacgtattggccacggcggccgcaacatcggccagggatgtgaaggtcgactcgatcaccagcccccgcaccggcagtgggacgtttttacgcgcagcatccttgccgagttctgcagccagatcgatcgcgacagcgccgccgagtgagtggccatagatcagccgtttgctgggatcaggttgcagcagcttgaagcgttcccacgccacccgcgcatcttcgtaaacgctgctttcggatggcagatcacccttgctctggccgaagccacggtagtcgatggccagcaccgaatagcccgccgcgcgcagttgttcgatgcggaacagctgtccggtgagattccagcgtacgccatgcagatacaggatggccggggcattgggtttttccgccggccaccaccaggcatggatgttttgtcccgccttgaaactcttcggttgcagatcgagttcctgaacgctgccgggcaggccgcgataccagccggccgtgcccggttcaatgcgaaacagcagcgtgcgctcggtgtgttcgagcacggcacaactcgtcggcacgccgataatcagcgcagccatgcaggcgaacgccaggcggcggcgacgcagacgggtcatgaaggcgaggaacattaaacgtttcaccaaaggtcggacaaagaacgctttttaccagatgccttggcctgcggcgtgacattttcgaccaccgtacctgcgcaacgattacaaaatgctgcaacaactcagcagacctgcagcacgatcttgccgatatggtcaccggcctccatgtgcgcgtgggcctgggcggcgtcggcgagcggatagaccttgtcgatgagtggcaggcagcgtccggcggccagcgctggccacacgtgcttgcgcagttcactggcaatcgccgctttttccgcagcattgcgcgcgcgcagcagcgagccggtaatcaccgcacgtttggccatcatcgccaacagatcaaagtcgttggccttcgcgccgccgaggaaaccgagcatcaccaaccggccgtccatcgccagggcactgacgttatcgttgaggtaggaaccgcccatgatgtcgagaatcacattcacgccctgaccagcggttttctcggcgatcactttggcgaactctacttcgcgatagttgatcggctggccaccgagcgtgctgatcgccgcgcatttctcagggctgccagcggtggcgaaggcttcgataccgaattcgcggcagagcatcagggcggtggtgccgatgccgctggtgccaccatggatcaacgcgcgctgacctttgctggcgccaccgagaccgaacagattggcccacacggtgaaaaacgtctccgggatcgcggcggcttgcacccagtcgagcccctcgggaatcggcagcgtttgcccggccggcacagcggcgtactcggcgtagccgccaccattggtcagcgcgcagacgcggtcaccgacggcgaacgggctgacgccggcgccaagggccacaaccaccccggcaacttccaggccggggatcgggttcatgcccggtttcatcgggtatttaccggcgcgctgcagtgcatccgggcgattgatcccggcggcgtgcacgcggatcaacacttcaccttcggcgacgtccgggagcggcacgcgtttggcttgcaagacgtcggggccaccgggttcggtaatttcgatgcgggtcatttcgtggggtaaggacatagtgcttccttctgataaaagtgcgtgtagatgggagtcgtgcatccctcgataaattcaggtcaatcccgataaccctgtgggagcgaggttgctcgcgaaggcgccgggacagtaagtgcagggttgtcagataaagcgctttcgcgaacaggctcgctcacacgttgggttatgcgggcccaaacgttcatggcctgttccaacagcaacgccacgccaatcgcaccgcaggcgatcatgaacagcatcacgtggtggccgccattggcgttgaacagcgccgaataggcaaacccggccagcgcctggaaagtggcaaacgacactgtggcgcggctccaggcgatttgctggcgagcgtgctccggcaccagttcgtgcacccgcgccaacgccagcggcacgatgcccggcgggaacgagccgagaatcaccgcgagcaacgccaacgccaggaatgattgggaaaccgccaacagcccgagggtaatcgcctgaatcaccagcaccaggcgaatgctcaaccgcgcgccgagcttgtcggccagaaaaccataactcaccgggccgacaatcgcgcccaaaccgtacatcacccacaccagcgcgccgacgtgcgcgccggcaccgaggccgcgggccacgtaatccaccagaaagaccatggctggcaccagtcccgcggccataaaggcgtactgcgcgaacaatacataaacgccggcaggtgtcggtgcaatcacggtgttttgcgcaacaatcggcgccggcagatcagcgggccagccaaaccagctcaccgctgtcagcaacagcgcgatgacaccgagccccagccatgtggcttgcaaaccgaggttcagcagtggcggcacaatcgtcccggagccggcaatgccgaggccgatgccgaggaatatcgcgccactggccaagcccttgcgagccggtggaacatgtggcagaaccgtcgccgcgaccagcaccatgattgcgcccccggcgatgcccgacagcaagcgccagccgaaaaaccagctcactgacaatgggaacgcacaggcgaagaatgccgcggtgaccaccagcatcatcaggcgcagggcgtttttattgccgagatgacgcgccatcgggcggccgagcagggcgccgatcaagtagccaatcagattggctgcgccgagatacaccacatcgttggcagaaaaccattgcgcctgaatcagcgcgggaatcagcggtgtgtaggcaaagcgtgccagtccaatgctgaccaggctggcgcagagcccagcgaggatcggcagccagagagcgccggaagtttgagtgcgcatgatattgacgtttccgaagaaggtttatggcgcccagcatatcggctatcgttgctgcgtttatgcagcgaatttccattgttgtgatgcgaaattgcatcaaggggaggcagggtgaattgggatgatgctcgggtgtttctcgcggtttgccgcgcgtcgacattgcgcggggccgcgcgtgttctgaatgtggatcaggcgacggtcgggcggcgcctcagcgcactggaaaagtcccttggcgcgacgttgttcctgcgtacctccgacggctacgccttgacggcggtaggcgaggcggcgctgaagaatgtcgagaaaatggagcattcagcactggaactggagcggcagatccaggggctcgatgatcgactgacaggcagtgtgcgggtcagtaccaccgattcgctggccatcgatttcctgataccggccatggcccgcctgcatgaactgcatccccaggtgcaggtgcaactcgacgcctctacgcaaattctcagtctggccaagcgcgaggcggatatcgcggtgcgcaatacgcgaccggacaacccggatttgatcgcccggcgaattgcccgttggcccgtaggacttttcgcagctcaggcatatgtcgatagcaagggcgcaccggagccgggcacggcatttgaaggccatgatctggtggtctatcaaccgtatctggcgaataaaaaggacctgaccctggtctctgaaccgatgactcgcgggcggatcgtcgccagtctcagttcaagtctgctggtacgccgctcgattgcagcaggcctgggcgttggagaaatcccggtctacatgggcgagcgcgacggtctggtcagagtctggccagagcgtacccggccagagccctatgaggtgtggctggtgacccatgcggatctgcgtcataccgcgcgggtgcgggcggtgatcgagcagatagtcgaggcgtttgcactggagaacgaataggttccagggcggttttggcagagctacaaggcctgacgaaacggcctacgtccgggtcagaatccgctggcttgtgagtctgcggggagagctctatcgttgacgtcaatggccacggaaggtctcggtaacccgaaaggtgtcgaattgaacgtcagggaagtgcttcaaaatccagtgtgtgacacgtcgagcgaaagtcggaatagccaagccatgaatgacatcagacgcgaagagttcaatgccaggatcgagaccatcgaggcacggatggatgcccgcatcagcgaggtgtcgacaaaaatcgatactcgggtgaatgaactgtcgacaaaaatcgatacccgggtgcgtgaagtgtcggcaagaatcgatgcgtttctcgtcgctcaggctgagcgggacaagtgtcaactcgaacgagataaacgctacgatttgctttcgatggaaatgcgagaaattgccaggaggacagaggaatctgtcaggcaaggcgctacggtaaaggctaatgtctgggcggccactgccgtgcagttggttggcatcgtggcgatcgttgtcggtgcctactatgccaaccaggccaacatgtatgtcgcgatgcaaacgacactggcagcgattcaggcgggcaaggagttcagcgtacccaatcccttcgagttttcattgcctgaatcggcgcaataaaaaaacggccttcagtgaaggccgttttttgtgggcgttaataaactgcctcatggcatctgcggcaactcctggggccgcaagtcaaacaccagcacttcggcatccacgccattgctcaaggtcagtgcctgttcttcacgaacccgcacgccgtcaccttcgcgcaattgcacgccgttcagttcgacactaccgcgtgccacatgcacgtaggcgtagcggttggccggcagttccagggtggcgctttcctggccgtcgaacagccctgcgtaaacccgtgcatcctgacgaactttcagcgatccgtgactgccttccggcgagatgatcagttgcagacgaccgcgttttttctgcgcgctgaaatgctcctgctggtaacgcggtctggcgccgctgacttccggcacgatccagatttgcaggaaatgcacaggcttgctcgccgagtggttgaactcgctgtgcgccacgccactgccggcgctcatcagttgcacgtcgccagggcggatgacggaaccggtgcccaaagtatccttgtgttccagcgccccttcgagcacgtaggaaaagatctccatgtcgcgatgcgggtgctggccaaaacctttgccggccgccacgcgatcatcgttgatcaccagcaggtcggagaaaccctgctcacgcgggtcgcggtagctggcgaaagaaaaggtgtggaacgacttcaaccagccatgattggcgaggccacgatcggaggctttgcgaagggtcagcatgatgaaatctccttgcgggacgtgaattcgtccgagtgaggagaaggttactgtttaccccgctgcacaataagtagatggaaattgaaagactgtcctgatcaggttgacagttttgcggcgccgttcacggaatttcttgccccggtatcgtcgcacttggccataatgttcggcctgtctgacacgtttatctttttttgatcacagtgatggttcccatgaaaaccgtggcaatggtgctgtttccagactttcttctgctcgacatggccgggccgatggaagtgttttcggtggccaaccgttacttgcaagccgagtcgcactatcaactgattacccttggcaccgagcacgggccattgcgcgcctccaatggcgtacgggtgcaggccgatcggcacattgatgacgccagtgatcactatgacttgctgctggtgccgggcggccccggcgcctacaacgaaagatttgcggggttgtgcgcctggctgccaggcgcggtgcagcgtgccgcctgttatggctcgatctgcaccggtgcgtttgtgctggggcatgccggattgcttgacggctatcgcgtcaccacccactggaactacaccgagcgtttgatcaaaggtttccccaaggccagcgtcgcgaccgatcagatttttgtcgaggatcgtaatctgatcacgtccggcggggtcaccgccgggattgacctggcactggccgtgattacccgggaccacggcaaaaaactcgcccaggacgtggccaaagtgctgctggtggtgatgaaacgtcagggcggtcaggcgcagttcagcccgttgatggctgccgtggccccgcaggaaacgcccgtcacgcgggtgcagaaccatgttctggaacacctggacgaagcgttcaccgtcgagcgcatggcgagtctggcgaacatgagcgcgcgtcacttcgcacgagtgttcgcccgtgacgtcaacatgaccccgatggagttcctgcaaagtgcgcgtatcgattgtgcgcgaaacttgctcgaaaccagtgatctgccgctgaaaaccgtggcctataaaagtggctttggcagcgtgcggcatatgcgctcgctgttcgccgaaaagctcggtctgacccccgcacagtaccgcgaacagttcagctagagcggttctgtccgtctggcgcacccggatgtccgtgctgcgccctgcgtggtggttgtaccgtcacctgaggctgccaagatacttggcatgaacagccattacgatttgaacccggcgtcggtgctgcgtttcggcccttacgcgtttcatttgcgccagcggctgatcctcgacggggatcggcaattgcgcatgggcggtcgcgcgctggacattctgcaagtactggtcgaacgcgccgggcgagtggtcagcaaagagcagttgatcgctctggtctggccgacgtcggtggtcgaagagatcaacttgcgtgtgcacatcgctgcgctgcgccgcgcattgcgcgacggcgagaacgctcagcgctacatcgtcaatgtcccgcaatgcggttacagcttcattgcgccggtgcattacgacagcacggcgcaattggttttcgagcacttgcaagcgccgcaacacaacctgcccgcccgactgacaccggtcactggtcgtgatgcgctggtcggcagcctggtgcggcaactgccactgtgccggatgatgacaatcacgggcgcggcgggcgtgggcaaaaccaccgtggcgctgcgcgtggccgaactgttgctcgagcatttttgtgatggcgtatggcgggtcgacctggcgtcgttcgacaacagcacgccactgctcgaagccgtgctcgacacgcttgaaaccgacttcgccacactcacgcagcgccatgccttgttggtgctggataactgcgagcacctgcgtgaacgctgtcaggcgctggtgcaacacttgctcgacgccgcaccgcgcctgtcggtactggcaaccagccgcgaggcgttgcgggtcaacctggaaacgctgcagccgttgcggccgctcacggtgcccaaatcgtccgagttgatcagtgtcgaggaggcgatgagttactcggcggtgcagttgttcgtcagccgtgcgcgcacccgtcagcagggattcatgctgcgtgaacaggatctcaaagcggtctgcgatatctgccgtcgactcgatggattgcctttggcaattgaactggcggtgacgcagatcgatgcgctggcactggtcgggctgcaggcgcaactgggcaattgcctgcagttactcagtcatggtcggcgcaccgccgtgccgcgtcatcgaacgctcaaggctgcgctggactggggatatcaaggcctgagcgacgccgagcaattggccttgcaacggctttcggtgttcccgaaagccttcacgctggatgacgcattggtcgttgtcacctgtacgaatctgccggcgcaggtgctggtggccgtggttgcgcaactggtcgccaagtcgttgctctgtgtcgagcggggcagtggaatagcgcgctaccggatgctcaacaccacgcgcagttacgcccgcgagcaatggctttcacaggcacagcgggccgaaatcgagcagcgccatgcgcgctacaaaagccgcgcttcagagattcagttggcggtttaaatcacacagcaggctgcgcactttgtgcaagtccggggtggcgtagccttcggtgaagcgttgatagatcggcgtcagcagttccagcgcttcgcgatagcggtgttgccgctgccacagttgcgccagtgaggtggcactgcgcaactcccaggcccgtgcgccttgagagcgggccacggacagggcttggaggaggattttctctgctgtctcaaggttatcgctagctgaactgacgtcatcgctggcaagccagctcccacaatgatttgcagttgaatccaaatcttcagaacaccccgcaaacctgtgggagctggcttgccaccgatggggggctggcagactgtcccgatccgcagccaacagtcgatccgcccgcgcccgcaaaatctccgccgtgctccaacccgcttcgccgctgcgcgctcgctcgaccagcgcctcgtcgacaaaccggtcatccagcgtgaccatgatttcccggatcaagccactgtcttgtgcctgcaccggcgcagcgttttcggcatcgatcacctgcgcgtaatgccgcgcccacgtatggaacagcagtaccgaatgcttctgcgattgttcgagcagcaactgcaacagtgcgcgggcgttctgctggtcaccgttgtaatgagcgatcaggcacgtggccaaggccagggtgtaacagatcgacgtgccgtggttgatctgcacggcgatgtccagcgcctgccgcgcggttttccaggcttgctcggggaagccttgcagccacagcacccgcgccagccccgtcagcgaggcaacgctctggtcatattgcacgccaaagccgtgggtgaaccgattgaggtggccgctgtgggccatgcgctcgatcacctgttcggcgtgctcccgggcctgcggctggtcgccagcgtaatgcaacgccagcacccgcaaccggtgtgtgctcagggacaacaacggatcaccgtgagtgccgagccggtcgaactgttcgctctgtatcagagccttgcggtaatgcccgcaactgaggttgaccgccatgtgcccggacaccgcacgcaactgtgcggcgacatcgccatgctcctgcgccagtgcgtcagccttgacgaacgcggcgatggtttccggcgtgccgccccacgtgtgatagcaagcgctaccgagggccagttgcagcgcaatgttcaggtgcgggcagggtggctgaataccttcaagcagattcaacgcctggcgcacgtagccaccgtactccttaagcagcgacagctcctgccagagcggcgccgatgctgccgtcaggcgaatccccagatcgtccggtccttcatcgttcaaacaccagcccagtgctgcgcgcaaatcttccagacctcgggcgtagcgttcgatccacaatgtggtcggggtgttttcccagtccgcctgcgccagatgcatcaacgccagacaacgttcggcatggcgttcacgggtttcagtcagttcggcagcctgttcgagtttttccagggcatagcggcgggtggtgtcgagcagacggtagaagacctcttcatcaccgacctcgacactgagcagtgatttggcggccaactgcgtgatcgaggcaaacaccgcaccgggttcgatctgcgggccaacgatcactgccgccgcagattccagagtgaaaccgccacgaaacacgctcaagcgacgcaggccagtctgctcacagcggttgagcaaattgaagctccagtccagcgtggcgcgcagggtcagatggcgctccaggctgctctgattacccggtgccaagggcggcagacgcccctgcaactggctcagcaatcccgccaatcccaattcggcgacctgcgccgcggccaattccagcgccaggggaataccgtccagccgatggcagatttcaatcaccaagggcaactgggcatcgcctaatacgaagttttcctgcgccgccgtggcgcgttcgacgaacagttgcggggctgagaacgcgagcgtttgctggtgatccagcacggtcgccatcaatggataatcgagggaatccagacgctgcacatattcgccttctgcccgcaggctctcacggctggtggcgagaatgtgcaccttcggcgccccgcgcatcacgctctcgctgagtgtggcaacggcatcaatcaaatgttcgcagttgtcgagcaccagcagcatctggcgttgactcaaaccatcgaccagacacgccagcggatcactctcgttcagtgtcagatcgagcagggcggccacgtgcgagcagatcagtcgaggatcgttgagcggcgccagatccaccagtcgaacgccgtcacgataccgctctatcagttgctcggcgacgcgcagggcgacggtggttttgccgatcccgccgggaccgacgagggtgatacaacgctggcgtggcaggtgcgtcatcaggctgtcgaccagcgcctggcgcccgatcattcgcgtgcggcgcagcggcaggttgtgccgggtggtgttgtcggctgagcgtggctcaatggattgcgaaagaatcggtgcgacgaaactgtagccgcgctgggccacggtaatgatgtagcgctggccggcctgcccatcgccaagggctttgcgcagcgccgccatgtgcacacgcaggttgatgtcttcgaccacactgtccggccacaccgccgccatcaactgctgcttgctcagtacctctccggcatgcgcgagcaacgtcaacagaatgtccatcgcccggcggcccaagcgcaagggttggtcgccttcgagcaccaagcgttgaacaggatcaatccgataggggccgaaaccgatggcctgattcggggaaagactcaacagctcgctcctgcggtgatgcggcggacaagacgaatcagggccgggcgcgcgcgcaggccttctgatccggggtgtcccggcataatcctcaggttttggcgtcagcgcaacggctggcgcagaagcgaacgtcaaaacagggcaggttgtggacggcgggtcttcggttcacgcatggcctgacagcgccaggcaaacgggttgatgccttcgctgcgggtgaacatatggcagaaatgcgcctgatcacagaagccgcattccagactgatctgcgtcaggctcaggtcggtgtgctggatcagcagcttggcgcgggcgatgcgctgggtacggatccagtcttgcggcgataccccggtgctgcacttgaaggcgcgggagaaatggctgcgtgacagcgaacaggcgcgggccagttcggtcacctcaaggctttcgcccaggcgttcgagaatcagttgtttgacctgtcgttcgcgttgtggactgagtccaccaatggcgcttttgcgcggttcgcaggcaggggcgagggcgacggtttgctgcaaataagccatggccaaggtccgtgtcggtggggaaggcgcgggcagcgcgctcccacaggtcaaaaatcaacgctgcgcagagggactcattgttggacggggcgtggccagtgacgagttaatcgttgttaatttcgctcaggctccacgttcacagggccgcggatcgcgtaaagtgcgcagcacttgcgtctggttggctataaggaatccgtgcccatgaaccgtaacgatctgcgccgcgtcgacatgaacctgctggtgatcttcgaagcactgatgttcgagaagaacctgacccgcgtcgccgaaaaactgttcatgggccagccggcggtcagtgcggcgctcgggcgtttgcgtgatctgttcgatgatccgttgctgctgcgcaacggtcgcggcatggagccgacagcacgtgcgctggccatcctcaaggagctgcagccggcgatggacgtgatttccggtgcggtcagccgggccaaggaattcgacccgacaaccagctgcgaggtgtttcgcatcggcttgtcggatgacgctgaattcggcctgtttccgccattgctgcgccagcttcaggaggaagcgccgggcattgtcgtggtcgtccgtcgcgccaattacctgttgatgccggcattgctggcgtccggcgaaatttccgttggcgtcagctacaccaccgatctgccggccaacgccaagcgcaagaagctgcgcgacattccctgcaaagtcctccgtggtgatgatcgtccggggccgctgaccctcgacgaatactgccagcgcccgcatgcgatggtgtcgttctccggtgatttgagcggcaatatcgacgtcgacctggccaaggtcggccgctcgcgccgcgtggtgctgggagtgccgcaattcagtggcttgcgtgccttgcttgccggcaccgagatgatcgccaccgtgccggattacgccgcctgcgctttggtcgagggttgtgcgttgcgcgccgaagacccgccgttcccgatcgatgcggcgcagttgtcgatggcgtggagcggggtgcatgacaatgatccggcggagaaatggctcagatcgcggatcagccagttcatgtcggctgcgctggatatcgagcagaaatgaggctgtacatagtccctggatcaacctgggccgttcgtcgggaacatgccttgacctgtaacttctgacagtagcgccaatgcacattccaatgtgtgatgaggtggtgtcctttggggccatatcaatcatgcaaggagtgaatgatgaaccgtccattggccacgatcaccactgacgacttgccaccacctttcgttcgggagagctcggctcccgccctcttgaatccggcgcatgccaggttttcgctgacgatcgtcgtggaagctgtcctcgagtccaccgacagaatcagtgtcaaatggcagggcgcaccgggtactcccgccgagggctcatacacctcgggcttttcggaagtgggcgacagacgcccggtagagcagaagtttttgtcttcgttggtgtctatcaaccaaagcaggacggtcacgctgacctacgacatcattcgcggcaacgccgcgccagtcacgtctcaaccgctgattctgtacgtgttgccgttggcacagagtgatctgcccaggccctttattgagcaggcagaacacgccggtgagggacagctgctgtttgtgcacgacctgagcctgtttgcgttgagaatcaatgcgtggctgctgatcaggcgaggtctttttttctgggcctggctcaaaggcaccaacgccaacggcagcgtatttgaacaacgttactggtttgctcccgacaacatggtcgacctggacttcttccgctttggctttttcaggcaaaacttccccgctgatccgcttaagggactcaaggatggtagtgtgctgacggtcgagttcagtgtttcgttcgatggtaatctggtcgaggctgatgcaatccgcttcgcaccgcgccactacattgtcaaaaccaatgcgcctcccactccgggaaaacccgccatcctctcggttaaagatgccgccggccaagacattgccaatggcggcgagacgaccgataccggcgtaacaatcagcggcagcgcgacggccggcgaacaagtggaggtttttgacgggagtgactccaagggcatggttcgcgccgattccggtatttggcagcttcccttgtctcctctgagtgtcggtccgcacccgttcaaggcgcaggctttgtatggcgatggagagatctccgacctatggacgatcaccgtcaagcaggttcaacgtggtgagctgtccattcaggagtctgccgatagcgtcaatctcgacccgctgaatgccaccgcttccctgactgcagtgctggattacgaccagcaacccaccgatatggtttctgtcacggtgaaggccgctgacggtacccccgctgtgggttcacatacctccacgccgattgccgcgggcactacaagacctttgaagatcaatttgccggtatcgctggtggcattcagcatcggaaaaataatggaggtgaccttcacctatacccgaggcgcttctgccccggtgacttcgcaacctctgcgcctcaacgttttgccgattgcccgcgatcgactcacggcgccactgatcactcaggccaacggcagcgatattctcgatctgaaagacgttcaatccggcgcaaatctgttgtttggtgtctggccgcacatttctgtgaatcaacgtatctggcttgatctggaaggacagagagacaccgggacgcacaacctgcagatgtgggtagggacgacgaacttggtgcatcgagcctgggttaccaatggcagcatcaggcctgtggtctcggccagctatctgcgactgctgaaggaaggcagcaagctggtcattcgcttcagggtcaatctggatcaggttgcgaacctcgatacggcagcgatctttcaaacgcgtgagtacaccattcgggctgtgccttagccaattcgaaacctgtccgttctactgtgtgatgagccggggagatttgtctttccagacgataccgttcgtcttgaattggcacacaactgtcagaactgtcaggtgcgcaatgccctgattcgcgatctgctaggacctgtccatacctcactgcacaggaacctggcacatgagtacgtcccgatccagcgacaccagcgtgttggcactttttccacccgacatccctgaggccgaccactcggtggtgggcgcagacgttggcataccgttgaaaatatccgatcaggtcgccgacgggctcggggcaacggtccgcgttgacccgattgccagtggatcgataaatccaggggacgtcattcaactgtttcgcgagggtgagtcggcattgctggacagtcaaatcatctctgacgtcaatgcagtcatttttctgcgcattccgaatggacggctgtctttcgacctggtcaatcgggtgttcttcaatatcgtgcgcggtagtcagaacatcgccacctcgccgaatctgaccgcgctgtacaacaagattcgcccaggactcaaggacacccagcccacagtcgaaggccatagcgaactgcacttggtgttgcccgatgccattctcgaaggcgttggagctgactttaccagtgctcaggtttgcgtcagttatccgtattgccgggcttacgacgtgattaccttgaagtgcaacgctagccttctgaattacaccgtcaagccgactgaggcgctaccgccgcccaatccgggatcggccgttcccatcaccgtttgtttccccgtgacccgggcctttctcgacagcgccaagcggccggaccagacattggagttcgcttttaccgtcaccgatcaacttggtaacaccgtcgatcccgatgcgctctggtcggcttcgcagatcgtcgacgaaaatctggagggtacccggttcgcgcccctgatctttcgggagagccaggcggacagcggcgatgtctcggaaatcattgaccgggagaaactcggtaaaaacccgctgctgttgattgtacgcaccgtcgacatccgtctgcgcttagacgacatcattcgggcaacctatcgctcccaggtcgcaggtcagccggacgtagtggttgacggcaaaatcgaagccgacgatttcggacagctcaagcccgtcatcttgcaagtggccaatgaccaagtgatttccggtgatgcggtaagtgggttttatcaggtattgcgtaacggtgtgctgctcggcatttccagcaccgctacggcacgggtggtgggcgaaggcttgccggagctgcaaccgccgcgattgcagaagtctgtcaacggcgtgctcgatccaacggatcctgccaaccttcaaggggcgaacgggcaggttgaagttcttgggtttcagccgggcgatacggttcggctgattgtcgaaggcgctcccggcgcaggatcgccagtgtttgaagcgaagcctctgaacgccaacagccgggccaactttcctctggatctggccttcatcgcagcgaacaggggtaaaccggtcaagcttcatttcttgttactgcgcaatggccggatattcgaatcgccatcgttgtcggttttcatcagtgaagcaccgagtctcgttgtgcctctggtcattggctcacgcgggaccacggtcaggtactggtcgaataaaggcagttcgcggattctgtcggcgcttgatccggtcagtctccagccgatggaaacagtgtggcagtacgaaggcgatagccggcagtttcgaggtcagcgtttcgatgatgtccaaccccggcgtttgcttcgggttggcagcgctggatatcaggtggtgttgcaacgtgccaatatcttcggcaacgggtggggtgatcccgctacgcctcgcgaagaacatggggtgcttgtcgccctgagggattccgacagtctggtggcatggggcgatcgcggctacgggggaattctgccgcctgccattgctgcactgcgcgatatcactgaggtgttcggtggtgcacgggctattgcggcattgcgcgctaatggttctgtcgtcggctggggagacgccggtttcggtggtgtggtgtccgccgaagtttcgcgcttgaccgacgtcatcaacgtcacacccggcggctatggcttcgcggtcattcgcgccaacggtcaagtgcaggcatggggcgacgcccgctttggcggggcagtaccggcggccatcgcgcggctcagcactgtcgtcagcgtttttgcgacggtctcggcattcgtggcgttgctcgccagtgggcaaattgtcgcctggggcgatgcgcgttttggtggcgccttgcccgcagagatcgccgcgctgcgcgacatcgtcgcagtcacctgcaaccacaacgcctgcgtggcgctcagagccaatggcacggtaatgggttggggggaggggcgttctggaggggaggtgcccgccgacattgcccgactcaccaatattgtcgaagtgaccagctccgggtcttcgttcgcggtgcggctgtccagcgggcgagttgccgcgtggggtaatccggccgcaggtggcctggtgccgtcgcgaatttccgcctacaccaacgtcatcgaactcattggcggcggctatggttttgcgttacgcctggacagcaacaggatcgatacatggggcgatcaggaccaaggcggcagggttccggacaccgtggcgcggcgggacgacatcatgcagatcgccagtaccaatggtgcctatgcggtgttgtatgccgacggcacagccgatgctttcggcaatccggtttgggggggcgatgtccgttcagttgccagtcaattgacaagcgtcagggcgattaccggtaacgcccaggcattcgccttcctgacggctgacggcagagtggtgaccgccggactcccggggggcggagggaatagtgatgcggttcaggatcaactgttccgccagctttcctattacctcgtttagccatcagaccgctgacgatacaggcgttgctgcagctttcggcagcgcctgtaccggttgaggctttcactttaaagagagcacgtacattcaagttttcccctcccggcctcggcatcattgcgttcgataagaattcaagggcgtgaggtcatgaacacttcgcaacagaatgaacgggcgcgcgacctcggtctgctgttcctgcgggccagcggcgggctgtttctgctgtgggttcacggcttgcccaagctgctggacttcaccgcacagctgcaactgatcgaagacccgttccacctcggtgcccacctcacgttgatcctggcgatcttcgccgaagtcgtctgtccgttactgatcgtcgccggattactggcgcgattggcctgcgtgcctattctctttgtgctgctggtggcgctgctggtcgtgcatccgcaatggagtgtggccgaggggcagttcggctggttgctgttgatcctgtttaccactgtgttgatcgccgggccgggacggctggcgatttctgttcgtttgcccggagtgttgcgttatgcctgaagtcctcaatccacaagtaccgggggccgatgagacggtcacgttgatcatcaaacaccgggtcaaggccggtttcgagtcggcatacgaggcctggctgcgcaatatcgtccgtgttgcggggcaacgcgaagggcatctgggcgttgatgtggtgcgcggcaagcgcggccgtctcgacttttacacctgcgtgctgcgcttcagttccaccgaagcgatgcaaggctggctggaatcgccgcagcgtcaggcgctggtcgccgaagccgcgccaatgctggctgatggcgatcagaccgaagtcgcgccggtcaatgaattctggtttaccccgctcgccgatgccgcgtcaccgccaccgcgctggaagcaggccgtggtcacgctgctggtgattctgccgcacaccttgctcgtaccgctgatctggggaccgctgctggcgctgcatccgctgctttccaactacgtggtcgccacgttcctgatcaccctgaccatcgtcctgtcggtggtgtacgtggtgatgccgccggtcacccgtttgtttacgccgtggctcgaagccagccaggcccatgaacacctcgattcccaagaaacctcgccgcgctgagcgcgcggggtttgctccttttcactttgcttgaggaactgcgatgagcgccgatctgattctgttcaatggccaatttcacaccgtcgaccgcaccaaaccactggccagtgccgtggcgatcaccgacggccgtttcgtggttgttggcaacgataatcaagccatggccctgcgtgggccgaacacgcaagtggtcgatatgcatggccgctgtgtcatccccggcctcaacgactcgcacttgcacctgatccgtggcggtttgaactacaacctcgaactgcgttgggaaggcgtgccgtcgctggccgatgcgttgcgcatgctcaaggatcaggccgaccgcacaccgacgccgcaatgggtgcgtgtggtcgggggctggaacgagttccagttcgccgaaaaacgcatgccgaccctggaagaaatcaaccaggccgcgccggacaccccggtgttcatcctgcacctgtatgaccgtgcgttgctcaaccgcgccgcgctgcgcgtggccggttacacccgtgacacgccgaatccgccgggtggcgagatcgttcgcgatgccaacggcaacccgaccggcatgctggtcgcacgaccgaacgcgatgatcctgtactcgacgctggccaaggggccgaagctgccgctggaatatcaggtcaactcgacccgccagttcatgcgcgaactcaatcgccttggcctgaccagtgcaatcgatgccggcggtggtttccagaactacccggacgattatcaggtgatcgagcagttggccaaagacgaccagttgaccgtgcgcatcgcctacaacctgttcacccaaaagccgaaagaagagctgagcgacttccagaactggactggcagcgtcaagttgcatcagggcgacgacttcctgcgccacaacggcgccggcgagatgctggtgttctcggcggcggactttgaagacttcctcgaaccgcgccccgatctgccgcaaaccatggaagaagagctggagccggtggtgcgccatttggtcgaacagcgctggccgttccgtttgcacgccacttacaacgaatcgatcagccgcatgctcgacgtgttcgagaaggtcaaccgcgacattccgttcaacggtttgccttggtttttcgaccacgctgaaaccatcaccccgcaaaacatcgagcgcgtgaaagcgttgggcggcggcatcgcgattcaggatcgcatggcgttccagggcgagtactttgtcgaccgctacggcaagcaagccgccgaagcgactccgccgatcaaacgcatgctcgccgaaggtgttccggtcggtgcgggcaccgatgcgacgcgggtttcgagctacaacccgtggacctcgctgtactggatggtcagcggtcgtaccgtcggcggtctggcgctgtatgaagaaggtctgccgcgcaccaccgcgctggaactgttcacccacggcagcgcctggttctcctcggagcagggcaagaaaggccagatcaaggtcgggcaactagcggatctggcggcgctgagcgcggacttcttccatgtcgaagaagaagcgatcaagtggatcgagtcggtcatgaccgtggtcggcggcaagattgtctacgccgctggcgacttcgaagacctcggcccgcgttcgattccggtgctgccggactggtcgccggtggtgaaggttccgggccactggcggccgaattcgccgttgcaggcgcaggttcaccaatgcagcggtccgtgcgccgtgcacacccacagccatgaaaaggcgcgaatgtcgaatgcgccggtcagcgacttcgccggtttctggggcgcgttcggctgttcctgcttcgctttctgatttcccctgaagcgccggccatccggtcggcgcttcacgcttcatccatccgtccatccaggagttttcccatgagcgttccttacacacgtctgaacaaagatgacgcggttgtactgctggtcgatcaccagaccggcctgatttcgctggtccaggatttcaccccgaacgaattcaagaacaacgtgctggcgctgggcgacatcgccaagttcttcaagctgccgaccattctgaccaccagtttcgacgccggcccgaacggcccgatcgtgcctgagctgcgcgagcagtttccggatgcgccgttcattcagcgtccgggccagatcaatgcctgggacaacgaagacttcgtcaaggcgatcaaggccaccggtcgcaaacaactgatcattgccggtgtggtgactgacgtttgtgtagcgttcccgaccttgtcggccattgctgaaggttacgaagtgtttgtggtgaccgactcgtcgggcaccttcaacactaccgtgcaacaagcggcgtgggcgcggatgtcggcggcgggtgcacacctgctgaactggttctcggtggcgtgcgagctgcagggtgactggcgcaacgacatggaaggtctggcgcatttgctgtcggagcgtctgccgaactatcgtaatttgatcaacagctataccaagttcactgccaagtaagatcaaaagatcgcagcctgcggcagctcctacagggggaacgcattccaatgtaggagctgccgcaggctgcgatcttttgcgttcaacgcttttgcaaccaacccagaaacccgcctttcctcaccgccaccggtttggccatcaacgcgaggcgactgttctgttgacgcaccgcctgcaatttattcaacgcccgacccacctccgtgcgcttttccatgcactcacgagtcagattcttgtcgaggcgataaatgatgctcgacgtcagcgccgtgaacgtcgcctgcgacggcgtatccgccagaatgctctgttcacccatgacctcactcggccccatgcgcccggcctcgattttgctgtcgccgtccggcacggtcgcgctgaccacgccagtggcaatcacaaacagactgtccggcacttcgtcgagatccagcaccacctggcccgccgtgtattgctgcgcgaccatcgactcggcgagccgatcacgttcctcgctgttcagcgaacggaagattttcacttcatcgagcagcgcacgggcgcgggtcgagggttcgatcacaccgtcgggatgccgggaaatgcctgcggcttcaaggtgccggtgggcgaggtcgaacaactgattacgcacctcgcttttcttgcccagctcagcaatgaaaccgctggccacgtattccgacatggtttcgccggcctctttcaaaacggcctttggcgccgggctaaggagcaaactgctgctgccctgcaaggtgcggtcgagcgcatcgagcactcggcgcggacgaatgtggttcggcactttgatgctgatcgacacgccatgcatgttgttcgggcgactgaggttgacgattttcgccttggccgccaccgagttcggcaccacggccatggttccggcgctggtcagcaagtgcgtggcgcgccagtcgatgtcgaagaccttgccttcgacgccgtcgatcatcaccagatcgtccacctgataaggcttggtggtgttgagcactatcccggaaaacacatcggccaaggtgctttgcagagccagaccgacaacgatggcgaccacaccggaggtcgccagcaagcctttcaccggcagctccagcacgtaacctgccgctgcgaccgtggcgatcaaaaacaccaaagcgccgatcacatcttgcagcaagcgaccgctgtggccgatacgacgcatcagcgccaggccgatgacttcggtcagcacccgcgcagcgtacagccaccagagaatccccagtgccgtcgcgcccagttgtgcgacccggtcatcgacgaacaccggcgcttgcaacggactgacaccggcgttgatcaccagcgccgtgaacgccagaaacagcaccagccgcacacccactcgcggggcgcgatgggtgaagggcgagaagtgccaaagtaccgcgtcgagcagcagcagggcggcgctccaggacagcaggtgagtgtagaaaagggtcatgaccagtgctccgcgacgctggtgggaaaaaagatcgcagcctgcggcagctcctacaggagaacgtattcccatgtaggagctgccgaaggctgcgatcgtttgccgttatggattcaggtgggttttcaactcagccgccgcctgacgcacggccgctttcacctcaggaatctggctcagcggattgagcaggccgaagtcatgaatcatcccgttgtaacgtaccgaggttaccgccacaccggccgcatcgaggtgccgcgcatagccttcgccttcatcacgcagcacgtcgaactcggcggtctgcaccagtgcagcaggcaagcctttgagctgttcggcgctggcgttcagcggcgaggcatggatctgcgcacgctcggccgggttggtggtgtagttatcccagaaccactgcatcatgcctttggtgaggaagtgaccctcggcaaattgctggtacgaaccgtcatcgaactgcgcgttggtcactggccacatcagcaactggaagcgcagcgccggggctttctgttccttggccatcaacgccacgaccgccgccatgttgccgccgacgctgttgccggccacggccaggcgcttgccgtcgacaccgatgtccttgccgtgctcggccacccatttcgtcgcggcgtaggcctggttgatcgcggtcgggtactgcgcttccggcgacggcgtgtaatcgacgtacaccgcaaccgcgccggaacccaccaccaagtcacgaatcaagcgttggtgggtcgggaaatcaccgagcacccagccaccgccgtggaagaacatgaacaccggcaactcgcctttgaccttggccgggcgcaccactttcaggttgatcgtctggccgtcgaccttgatcgccttgtcgctgacttcaacgcccgacagatccacgttcaccgaagcctgggcgccggtcagcaccgcacgggcgtctttcgggctcagttgctccagcgggcgaccaccgccagcggcgagcgcatcgaggaatgcctgggtgttgtgttccacgccagggctgccggcggcaaaagcgctgctgacggaaagggcgaggagggaagcggtgagggttttcttgacgatgttcatggtggaaatccttttgaataattttgattttttgcctgagttgcgggctgctgtggcgctgggcttcaggcctcagcaacaccgtgagcacagattaatgagctgcttgaaagtgaaaaagcggctataaagcgtttaactgtccaccagagagtgacaatgaacccgttcgaagacatgcgtattttttgccaggtcatggactccggcagctttacctccgcggccgatcagttggggctttccaagcaattcgtcagccggcgcttgatgcaactggaagaacgccttggcgtgcggttgttgaaccgctcgacgcggcgtctggacgtcacgccactggggcagagctattacgaatcggcgctgcggcttttgggcgaggtcgagcaagtggagcagggcatcgccgggcagactgccgagccgcgcggaacgatccgcttgagtgcgccgctgtcgtttgccgtggcgcatctgggttgcctgctgccgatgtttttgcagcgctatcgcgaggtcacggtggaggtcgatctgagtgatcggccggtggatttgctcggcgagggctacgacttggcgttgcgcattggcgtgctcgaagactcgacgctgattgctcggcgcatcgcttcgatcgaacgggtgtactgcgccagcccggcgtatctggctgaacgtggcacgccgcttaaaccggaagatctgcacagccatgattgcctgccttacggacacgggcgctcggtgcaatggcggtttaatgcggggcagggtaagccgctgctggtcaatgtcaccgggcgcatgcgcgttaacaacggcgagttgctcagggatgcggcggtgcaggggatgggcattacttatctgccgacgttcattgtcggcgcggcgttgaaagacggccggttggtgccggtgctggatgatttgcgcccggaaccgctgacactttcagccgtttacccgcaacaccgccaagcctccagaccggtgcaggcgttggtcgagtttttgcgtgaacgcctgaacgagagccacgtcgccctctgagccgtacgcaaatcaaactgtaggagtgagcctgctcgcgatagcagtctgtctgtcacagcttcagtgtctgaatgaccgctatcgcgagcaggctcactcctacaattgatggtggttgtttgcggaatctgtgtacgccgcaaaaccctgtgggagctggcttgccagcgatggcggtgtgtcaggcaatacaattttgtctgacccggcctcatcgctggcaagccagctcccacagggggtgtggtgttttcaggatggatcagttggcgcgcttgtcatcgcccggctcgccgccgacatgtacgccacgatcatcgccgacttcgcctgcagcatgcacgccacgatcatcaccgacttcacccgcgcggtggacgccatggtcatctcccgcttcggcgtgcgtgccgctgcgaccggatgagccgctgtcgcccgagtgtcccgagccgtggtcgctgccgctgtggccactgttcccgccgccaccgctgccgctattaccgcctccgccgtgactgcctccgccgccacttccgcccccaccatttccaccgctgccaccaccgccgccaccgtgaccgccgccgccccctccgctaccgcccccactgcctccaccaccactcccaccatccttggcctgagcactggacaccccggacaaactgtccgggataagtatcgtagacgccgacagaactgcgccgatggccattgcgagcacgagctttttaaggtgcatatcgttctccgtctttgtggtcttgttgggaacgtaaaagtgccttgttacagggcccggacccgttcccggagtcagtgaatactcgaagccagttcgaaaatcgggatgtacatcaggatcacgatgaccccgatcagcaggccgataaacgtcatcaacagcggttcgaacaacttcacgaaccactccagccagcggctgatttcctcgtcatagaagtcggcgctgcgctccatcatctgcccgaggttgcccgactgttcaccggcgcgcagcaggcgcagggacaccggcgtcaccaggtgattgagttccagcgcggtagacaacgattgcccctcgcgcacccgctcgcaggcctggtccaggcgcacgcgtgaagccacggtgagcaaaccgcgcaccatgcccatggccgtcaccagcggaatcccgccttgcagcagaatccccagcgaacgataaaatcgcgccagttcatacatgaaaatccgttgatgcacggcaggcagtttctccaccagccgatccagcccacggcgaaacgccggttgcttttgcagcacggcgagggcgatgacaatcgctgccagcgcaccgaaaaactcagcctgatgcgcatgcagaaacatgccgctgctcatcaacacctgcgacagccacggcaggttattgcccaagccttcaaacaccaggctgaagcgcggcaccacataacccatcaagaacaacaccacgccaccgccgaccaccagcaacagcatcgggtagatcgaggcgctgatgatcttctgccgcacctcgtccatgcgctggcgatagctgacgtagcgccccagcgcatcgccgaccgcgccggtcttttcgctggactgcaccagcgccacgtacaacggcgggaacaccgccgacaactggcccagcgcctgcgaaaacgatttgccctcgtacagcaggcgcaccagctcactcaaggttttccgggcagccggggcggtttctttttcggcgaggctttccagcgcatcgatcagcggtaggccggcattgagcaaagtggtcagttcctggctgaacaacaccaggttgaaggtctcgcgctggcgcagtttcagcgaacgccaatgcttgtcggcgtgcgagctgagcacgcgcaaaccttggtcctcggcgatccgccgcgcctcgctgtcacccggcgcttccacactcaaggacaccacgccagccttgccgaccgctttcaaatgaaatcgcatgggccgcgctccgctcactgccagttggtcacttcggcattttcgccttcgccgccgggctggccgtccttgcccatcgacagcaagtcgtactcgctgttttcgccgggatagcggtaggcgtagttacgcccccacggatcctgcggcagctttttctgcaggtacgggccggtccatttcgcctcgtcgctgggtgcggtgaccaaggcctgcaagccctgctcggtggacgggtaatggccgacttccagtcgatagatatccagcgctttgctcagtccttcgatctgcgccttggccactttcacttccgagcggccgagttgggcgaagtatttcggcgcgacgatcccggccaacaggccgagcaccaccagcaccacgagcaattcgagcagggtaaaaccgcgttggctacgcggacgaaattgcagcttcatgatgacctcccgtgagtggcagccgtgtcgccagaagggcttatgcaattgccatgctcagcccccactgaaaatcacctgattggctgaagcccttgtgatccgggcatctcaagagtcggcacagtgcttgcgtatggctcaaacgtgatcggccattggggcatttcccccaatttatcggggtcgatccggggaggcccgacatgaaatttctcgccagcggattgctcggatgtgtgctgctcagcggcgccgcgcaggccgatgtgttcatctcggtggacgccaagggcagctatgtactgtccaacgtgcaccggcccggacgcacctacgaacgggtgatccgcgaagctgaagccactgtggtcagcctcgatcagcagccgcaaatgatcgccaaccagccctacgcggaacttgtttcggcagccgccaaagtcaatcagttgcctgaagcattgctgcacgcggtgatcaacgccgagtcccattacaaccccggtgccacgtcgcccaaaggcgccggcgggctcatgcaattgatgcccgacaccgcacgggagttgggggtgaccgacgtctacgaccccaaggccaacatccagggcggggccaaatacctcaagcgcctgatgaccctgttcgacaacgacatcgccctcgccgtagcggcttacaacgcaggtcccgacgcggtgctcagccgtggccgggtaattccgccgttcgccgaaacccagcgttatgtaccgaatgtgttgcgtcagtaccggcgtttgcaagggttggcgatggacgcgccgttgtaaccccaacccggtttccccactttcggggcaaaccggatagacccgaaaagtggggaataggggtggggaatattccccggattctcaagtggtcgcggtaactgactgaacattaatgcaattttttgtggcacgcggattgctccgaggcatttgtcgagaagtgttcccacgagcacccactacgaggttcctgatcatggctggcttccctcacgctccgtccctgattaactggctgctgattctggcctcgatgctcagcgtcgagctggccggcgcggccgtgcgttgcgagcgcaacctggtggccaacgtcgtcgccttcgatcaaccgctgatgttcaaccgcctcggtgcgcagaacatcaacggcatgatgttcgccctgcgtcgcgacgtggtggatgagcatgagcagtcgctggcttacggcggcgccgcggtgccgggcaaagtctcgctgcgcccggacaagcgtccacggccgctggtgctgcgcgtggctgccggcgattgcctgacgatcaatctgcagaacctgctcgactatcaggccaacccgaacaagcactttgagaacgagggcgaagaagagggcgcggaaaacgccaacggcgccgaagacttcaaagtcgatgagcaggtggcggatcgtcacgtcggtttccaggtcaacggcctgcaagcggtgaacagcatcgatgacatttcctcgttcaccgggcggaacgccaatacgttggtgccaccgggcgcgagtcgttcttacaccttgtacgccgaacgtgaaggcgcgtttgccgtcagcagccgtggcgcgacgtttggcggcgagggcgcggccggcaacgtcgccaatggtctgttcggccaggtcgtcgtgttgcccaagggcggtcgcacctatcgcaataccctcaccgaagaagaaatgcgcctggccaccaccggccgtgcacccactggccaaccgatcgttgattaccaggcgcgctacccgcaacgcgaaccttggttgcgcgaaggcaaggccggtacgccgatcatcggcatggtcgacggcaatgaaatcatctccagcgaaagcgatgcgattgtcatgggcagcaacgccgacggcagtttcccgtccagcacttatccgctggaatcggtaggcaaacgcaacccggcgatccccaaccgcctcgaagcgttccgcgattttgcctcgcagttccaggacgaaaccgccgccacccaagcgttccccgcgtactgggccgacccggtgatggcccatgtgctggagccgacccgcgactcgttcatgatcaactatggctccggcggcatgggcgccgaagtagtcgccaaccgcctgggcgtggggccgatgcacgattgcctgtcgtgcgcttatgaagaattcttcctcagctcgcacaccgtcggcgatgtggcgatgctggtggatgtgccggccaacaccgggcttgagaacatcgcccccggccagataccgcgcgccgatcagatcggtgtgaaagccaccatggccctgtatccgtcggagccgtcgaacgtcaaccacagctacatcggtgacttcgtcaaattccgcaatacccacaatggtcacgagcagcacatcttccacttgcacggccatcagtggctgttcaaccccaacgacgacaactccgattacgtcgacgcgcaaggcatcggcccgggtgccggttatacctatgaaatcgccaacggtggttcgggcaaccgcaaccgcgtggccggcgatgcgatctatcactgccatttctatccgcacttcgcccagggcatgtgggccatgtggcgggtgcacgatgtgttcgaagaaggcacccgactcgacgtttcccagcaaggcgccgacggttatcacagcgaaccgtttgccttgcgcagcggcaaaccggcggccggggcacgcgccttgcctgacggcgaaatcgttgccggtacaccgattccggcgattgtgccgctgccgggcaaagccatggcgccaatgccgggcaaagtcgtggtggtgccgaaaatcggcgaaaccctgatcgccggcaatgacgacgatgacgaagaagagggcgacgacgacggcgagcaccatggcggcaacgccggcggtcaagccatcggttcactggcgctggtcgatcgcagcgaagccaaccgcaacgccgacggcagcctgaaaaaccctggctatccgttctggatcggcggcatggaaagttcggtcggccaacgtccgccaaccccgccgctggacatgctcgacgccgccaccgcgcagtctttgaaggccagcggcaaagcgctgtgggccaaccttgacccggcgcagtctggcggttgggatggcggcttgcagcgtcatgcactcgacggggtcgcggccggtggcgaggcgcacaccgtgaccacttcgctggatttctccaaggaagtcacccgcgccaaaccgatttacctgccggaagaaggcaccgaagtcgaacaggcggcgatggccttccacgcgaaaaaagaccatccaagctatgccttgctgcccggcaatcaagtggtggccaaggccttccgcaccaacggcgccttgccgatggccggcgcgccgtactacgagccgtgcatggacgatcggcaaaaacgcctgaccgccagcgctggcagcggtgagttcgccagcggtgagcgcctcgacggcatgtcctttgtcggcgcctcgagcttcaccgccgatcgcccacgcatctacaaagccgccaacattcagttcgacgcggtgtacaacaaggtcggttatcacttcccgcaagcgcgcattctggcgctgtgggaagacgcctggccggtgatcaccaagcagcgtccgccagagccgctggtaatgcgcatgaacaccttcgattgcgtgcaataccagcaaaccaacctggtgccggccacctacgagatggacgactatcaggtgcgcacgccgaccgatgtgatcggccagcacattcacttgccgaagtgggatctgacctcggcggacggctcgtccaacggctggaactacgaggatggcgtgctctcgccgggcgccgtgcaggaacgcattcacgcgatccgcgaattcaatcagtgcgccggcaccgatccacgtgacggcacccaggcctgcccgaaagccaagaaccatccgttcttcggtcagtacggccgcgccgattgggtcggtgcgcgcacggcgatgcagcgttggttcgttgatccggtggtcaatgcaaaaggcgtcgatcgcggcctcggcacgatcttcacccatgaccacttaggcccatcgacgcaccagcagattggtctgtacgccaccgtgttggcggaaccggccggttccacttggttccacgccgaaaccggtgagcctctgtacagcggcgcgcgtcaggacggtgggccgacgtcgtggcaagcggtgatcaataccggtgacctcgatggcgacggcaagaacgacagcttccgcgagttcttcctcgagtacagcgacttccagcacgcctatgaagctggcgtctatgtcggtgccgggcctaacggtgtgccgaatgcgcaggcgttcccggcgactgccgacagcttccgctacgcaatcaacccgccagtgcgcaacaacgccagcaacctgcttgagggtgtgctggaagtgcagggcggtcaggtcccgggctgcccgagccggccatgtccgcaggcgatttcggtggatgatccgggcatgttcgtcgtcaactatcgcaacgaaccgctggccctgcgtgtgtatgacccgaacaaggtcggcccggacggcaagcgcggcatgcaggccgacggcctcggcggcgatctgtcgttcgccatgcaaagccgtaccgaccgggcgatcccggcgatgaacctggcgccgaatctgctcacctcggcgaccggcccaaccggcggcaccacgctgttcccgccgcacatcaacaagggcggcgccgaacccggtgacccgttcacgccgatgctgcgcacttacaccggcgacaacgtgcggctgcgggtacatgccggcggccatgaagaagagcacaacgtcaccctgcacggcgtgaaatggctgcagagcggttccggtttcggcaacagttccaactccggctggcgtgcgtcgcagatgatcggcatctccgagcagatgggcttcattgcgccggtgtcgatgctgtccagttcggcggcgaccacgggcgactatctgtactcgatggacgcttcgatcgaaggctactggagcggtatctggggcgtgatgcgcaactacaccgccaaacgcgccgacctgttcgctatcccaaataacccaagcccggcgggcatgcgcaacaccgtggcgttcgagggcagttgcccgcgctatggcgccaaccctaacggcattggcactcggcccactgtgcagcgcaactatgaagtggtcgcggcgctggccaatgacatcctcggcaatacgctggggctgaccatcggcgatcccgaagggcttggccagcatgtcggcgggccgctgaatccggcgggtggcaccctggtgctgaactcgcgcacggtgagcattccgcaggtcaccgtgaccgatccggaggatggcgaaaccatcaccatcggcgggcagagcgggccgctgcatgacccgaccgcgatcctctatgtgcgtaaatctgatctcgatccggtcagcggcaagctcaaacccggcatcccggtcgaaccgctggtgttgcgtgccgcggcaggggactgcatcaacatcaccctggaaaaccgtttgccgagtgtgatgccggatctgacccagacggcggtgatgcagggcatggtcaagcgtgatcgcaacagcggtctgggttctaccaccttcagtaacaacctcatgcggccgtccagccacgtcggtctgcacgcgcagttgctggcgtatgacatcaccaaatccgacggcgccaacgtcggtgccaacccgatccagaccgtgccaccgcgcgtcggcaacagtggcgcgtatccgacccgtacttatcagtactacgccgggcacctggagcgtgaaggcaaaccggtgactcaactgggccgcagcgtcgacaacatcaatgccacggcggtggagttcggcggcttgaacatcaccccggcggacgtgatcaagcagccgcaaaaaggtcttggcggggcgatgagcattctgccgatcggcgcgacctgggttgatgatgcgcgcaaggtcaacgctacggtgacggcacctgggcaaaccagctaccgcgactttgcgatggtctggcacaaggcgttgaacacccgttgggccaatggccggccggtggaagggatcgctgctgagggcttcggcgtgccgaccgatccgcaggacaactcgagcatggcgatcaactacaagaccgagccgctgtggtaccgcttcggcctcgccccggatgcaccgtttggtcatgccgatggcgcgggttacggcgacatggtcaatgcgcacatggcttacagcaatgcgctggtcggtggagatccgcagaccccggtgctctacgccaaaccggggcagccgttgcgtacgcatattttgatgccgagcggtggcagtcgtggcaccacgttccagctcgacgggcacgtctggtcggtgaacccgttccaggccgagaagagcgacaccggaggttatccgatgggctcgccgggcgtcggctcggtgcgcttcggctacaacccgatgtcgatgtacatcggcgcccacgaaagcatcctgccggccgcgcacttcagcttcatgatccccagcgccggcggcagcaatgcgatcccgggggattacctgttccgcgactacggggcctacggcaacacctccggattatggggactgctgcgcgtaaccaacgaaccggaaccggcgccgcaggggcagtagcagaacggtaatgtcccggtggatgcaaatcccctgtaggagtgagcctgctcgcgattggggctactcggtttcggatggtgaggcagatgacgctatcgcgagcaggctcactcctacaggggccggtggtgggcagtgaggatgcggtaggaatgcaaatcccttgtgggagcgagcctgctcgcgaatggagctactcggtttcaaggctgcagctgaagacgccttcgcgagcaggctcactcctacagggtcggtgttttgtcaggtagcgtttggggagtgcgagatgaacaggatcatcaacatcatcggtatttgctcgctggccatggctggggcggtgctgtcgctgagtgaaattgccttggcgcaaaccggcagcgggcagacgctgaaccgcgacggcgtggcggtggatttcaacctcaagccgctggccgccgacggcaaactgcgtgaaggcgagttcgccgatgtgcagttccgcgtcactgacagcgcctcaggccagccgctgtccggggtggcgccgggtgcctgggtcgatccgcagaccctcgccgccgatcaagcccagggccgcgaccagagctgcaaagcccgggtcggggtattcctcaaatccaacatcggcgcgcgaccgttgctcgatctcaacagctatttcctgctggtgatgaaccgcgacgcgagcatcgccgtggtcgatccatcggtctcggtcggcggcattaccagcaccctcgcgcggatcgaactcaaacaaccgccgatggactgggtcacccccaaagacaacaaacgcgtgttcgtctcgatgccgacagcgggcgaagtggtcgtcatcgacagcgaacaattcaaggttctcgattcggtcaaggccggcagccaaccggtgcgcgtggcactgcaacccgatgaacgtctgctctgggtcggcaacaacgcgagcaaaaccgaagactccggcgtcacagtgatcgacgcccaaagcctcaaatccctcaaacatttacagaccggtcgcggccaccacgaaatcaccttcagcaaagacagccgcttcgccttcgtcagcaaccgcgacgacggcacgttaagcgtgatcgacatcgccagcctgaccatcgtcgagcagatcaaaaccggctcccacccattgtcagtcgcctattctgcgctgtccggcgcggtctacgtggccgatggcaaggacggcaacgtgaccgtgatcgacgccagcacccatgccattcgccgggtgatcaaactgcaacaaggcctcggcccgatgggcttcagcgccgatggccgctttggcgtggtactgaacaccgtggaaaaccgcgccagcgtcattgacgctgcgaccaacacagcaatccatgatctggacgtcagcgccgaaccctaccaagtggtgttcacccaggcctacgcctacattcgcggactcgcctcgccaaaagtcaccatgatcaacctgtcgtccctcggcgaaggtcgccagccgatcagccagggcttcgaagccggcccgcaagcgccgcgcctggccggggatttgccactggcctcaagcctggcggtgtcgcgcgacgacaacgcagtgttcgtggtcaacccggtcgacaacaccacctacttctacgccgaaggcatgaacgcgccgatgtccggttaccccaaccgtggccagatcgcccgcgccgccatggtcatcgaccgcagcctgcgcgaggtctcgccgggcctctacagcgcgcgggtgaaactgccggcagcggggcgtttcgacgtggcattcctgctcaatcaaccgaacatcattcattgcttcactgcgctaattgatcctgacggcaaaccgcaaaaacacctcggccagccgaaggtcgagttccttctcgacaagacggccgttgcgctcaacgacccctacgtcgtgcgttttcgcatcgttcaaggcaaagacaaaacccagcgcagcggggtgaaagacgtgcagttgcgctattacctcgcgcccacttcgcacccgcgtgaagtggcggcgctggaagtcgctgacggcgtatacgaagcgccgatcagcctcgaccgcagcggcgcctggtacctgcatgtgcgtgcggcatcgctgggtgccggtttcgatgacaagacctttgccagtgttcgggtagcccccggccaggcccgttgaagaggagtttcgacatgaagcgatttgcatccactggcctgctgaccctgtgcctgttgagcctcggcattcaacaagtccacgctcattcggccgacgaacacgccggacacaaagcccccgccagcagcactcaggaacacgcccaggtgaaattcgccaacgtgccgctgctcgatcaaaacggtaaaaccgtgcgcctggaacaagacctggtgcagggcaaaatcgtcgtcatgagctttatctacaccagttgcaccacggtgtgcccggtggtctcgtcgatcatgggcaaggtgcagaaacaactcggcgcgcgcgtcggcgatgaagtgcaactggtctcgatcagcatcgacccgcaacgcgatgacccgaaacgcttgcaggattatgcgcgcgcgtttcagcgcgggccgggctggagctggctgaccggctcgccgcagtcgatcaatgaaaccctcaagggccttggcagtttcagtggcgacctgaaaagtcatcaaccgctgatcctcgtcggcgacggcgacagccgccactggatgcgctactacggcttcactgacccggcgctgctggccaaggaagtcgagaaactcagtggcctgcgcactcacgccaaacacaccgccatcgccatggagcaacagccatgagactgctcgactggatctccctgaccgtatgtttctggatcttcagcaccgtggcgtttgcccacgaaggccacgtctctgagccgcaagccgctgtggccgccgccccggccaaaggcacccacgacgcgaaaacctggttcaccgacacgccgttgcaggatcagaacggcgagaccctgcgcttctacagcgacgcgctgcaaaaccgcatcgttctgctcaacgtgatcttcaccagttgcaacgatgcctgtccgctgatcacccaaaagctcaaggaagtccgcgagctgctcggtgacaaggcgcaggacattaccttcatttcccttaccagtgacccgctgcgcgacacgccggcggtgctcaaggcttacaccttgaagcagggttccgatgaccctcattggctttttcttactggcgacaaaacgcagatggacctggtattgagccgcatcggccagatcgtgccgacccccgagcagcactccacgcagttgatcgtcggcgatgtcgccaataaacgctggagcaagatccgtcccgacgcacctgccgccgccattgcccagcgcttgcagttgctgacaatgcccgtggccggccgctgagcccgcgccatgaaccgctgccgcgtcctcgccctgatcctgctcgctggcatcagccttggcgcgagcgctgcgccgctgactgcggaagaggcggcgggcaagcgcctgtaccgccaaggcctttccgccagcggcgaagcgatcatggcgcgggtcggcgcggcgggtgtgttactgccggcgaccagcctgccgtgcgccaattgccacggcgccgatggcctcggtcggcccgaaggcggggtacgtccgccgccgctgaactgggcgcgactgaccagcacttacggccagcgacaggtcaacggtcgcagctatccggcgtacaccgagagcagtctggccaccgtcatcgagcagggccgcgaccctggtgacaatcgcctcgacccgagcatgccgcgctttgtgctgtcgatgaaggatcagcgcaacctcaccgcgtacctcaaacgcctggccgacgaacgcgaccccggcctcgatgccgagaccttgcacctgggcacgttgttgcccagtcagggcccgctggcggaagagggcatgaccatcgcagcgatacttaacggcagcgtggcgcggatcaatcaggctggcggcattcatggccggcaactgcgcttgacggtggttgacccgggcccggatcgcgccagtgccgaacaagccttacagcggttgatcgagcaggaacaggtttttgcgttggtagcaccgctggcgccggccctcgacggcgaactggcgagccgcttggaacagtccggcgtaccgctgattggcgccttgtcgtcgctcggctcgatgcaggccagtccgcagattttcgagccgttgccgggcttgcgcgagcaactgatcgcgctggccgattacgccacggccagcctgcgcgtgctgcaagggccgacgctgattgcttatcccgatgacccgttgcaagcgcaagcggcgaccacgctcgctgaatacttgcaggatcacggctggcagaaagttcatctgcaagcctacgacccggcagcagaggctttgccactgggttcgcgctcggtgttttatctgggcactggtggtggtttcggacgtctggccacacgcctgcaagacgccgggcaggtgccatacctgttcgccgcttcgagccaggttgctggtgagttgctgcaagtgccggaggggttctcgcggcgcgtgtttctcgcctatccgttcgtgcccagcgactggacccagaccgggcgcatggccctgacgctgttgcgcgaaggtcagggtctcggcgcccaacacgcggtgctgcaagtcggcgcctacgcctcgatgttgctgctcagcgagggcatgaaacaggccggccgcgacgccagccgcgaaaaactggtgacggcgctggaaggtctgcacgacttcgacaccggcctgaccccgcgcctgagtttcgggcccggccgacgtctgggcctgagtggcgcgcacgtggtcaccgtggatttgcccgatcagcgcttctatctggtcgcgccctataaaccgattgttgccagcccctgaacggagggcccgatcatgaagctcagaatgctgatcttgttgctgacctgttggctcccgttgacgtgggccaataacgaaccggccgtggcgcgggtcaatggcgaagaaatctccgggtttcgttttgagcgcttcttcatcgaataccttgaggatcagggccgcgcggtggcgagcattcgcaatcccaaggcctacaaacagctgcgccaggcggcgctgcaaacgctgatcgacaaggaactgctgtggcaggagtcgcaaaaacgcggggtgcagatcgacgagcaagcggtgcttgcgcaagtcgagcaaacccgcagcgctatcggcggcacggataaattcgtccggcgcttgcaggacgccggtttcgacgaggcgtctttcaccgaatacacccgccgcgaactggcggcgcagcagacattcgccgagctgatccgcgccaataccttgcaaccccggcacctgataatccgtgtgcccgcacaagcggatgcagccacagtcgcggcagcgcgtctacgcttgttgcaaatgcgcgcctcgatcattagcggggcgacattcgccagccaacccgtgcgttcaccgttcggctggcatgtgatttatttgcagaaccacttggaggccgccgatgtcccagattcgcaggggctggatacagtcagggcacagctcgcccgacagcaacagacccaggctcgtcgccaagtgctcgcgcaattacgggtgcagaacaggatcgaacgaattgacgacgactgaaggttcccccccaatagtggggaatggcttcgatgcccattcaggtgcttccccgtttctggggaacggggtaccgggacgagcgggcattgtcattaatttcaaggacatgaagacgtaaaattaccggcactcagcctggcatgaagtgtgcgttaccgatggtaaggcgcactctcagggcggggtcatcggacctgctgtttcaaggagtcgaccttggttaacaaagtactggttgtcgaagacgaacagctgcttgcacagaaccttcaggattatctgttggcgcaggggctggacgtccggattgcacatgacggagcgacggcgatcggcctggccgaaacctttgcccccgacgtgctggtgttcgattaccgcttgcccgatatggaaggctttgaggtgctcgacgcggtccgccagaacaggacgtgccattttgtgctgataacgggtcacccgaccgctgaagtctgtgagcgggcgcggcaactggaagtcagccacatcctgttcaaaccgtttccattggcggaactggcccgagctgtctgcgaccttcttggcatcaagcgcgaagcgaaacccggtgcgagcccttcagaaggctttgtcgaacgacgccagagcaggaccgagagcttcccgttgcagttgtacgatggcagttgggtgttggcggatcggcgacggcagtcgcaatccatggcgccggacgacgatcaaatgctcaccggggagtaatggcgcgatcagacgttccggcttttgccgccaaggtttgccgcgccgacagggctctaagccccggttggagagcaagccatggaacgtctgtccgttgtcgtcgaaccgctgttggccgaatgcgcgccagaacgtttttccagtgagcagcttgcccaggcccgggcgcgggccgccacttccggcgaacgtgttctcgaagccctcggcgtcctctgtgaactggcgccgatgccgttcattcacaccctcggcgcgaccctgcattacccggtgctcgacaccgacagcctgtttgccgcgacgccggtgttcgaccgggtcaccctcgcacaatgcctgaaacgtgaattcatcctgctgcgccacaacgacgaagtcatcggcgtgtttgccgaccccttcgacccggcgcggctggcctggatcgacgattgtctgcacggcgcgccgctgcatctggtccacgccgatgacctcaaggcctatctggcccgccacgaagaaagtttccacgccgtcgaatcgctcaacgcccaaggcgacacccacagcgaaatcgacaccgtgcaaagcctgtcgctgaccagcatcagcgaagacgccagcagcgtggtgaaactggtcaactcgaccctctacgacgcgttgaaaatgcacgccagcgacatccacctcggcaccaccggccacggtctggtgatcaagtaccgcatcgatggcgtgctcaacaacatcagcaaagtccagggcaacgagttcgccgagcaggtgatttcgcgggtcaaggtcatggctgaactggacatcggcgagaaacgcgtgccgcaggacgggcgcttcaagatcggcatcagtggccggcagatcgacttccgcgtgtcgatcatgccgagcatcttcggcgaagacgcggtgctgcgggtgctcgacaaacaggacctcgccgacaaggtctgcggtgtgcaattgcaggcgctgggctttgaagacgaaaccctgcgccagttgcgccgcctcgccgccgagccctacggcatggtcctggtgacgggcccgaccggcagcggcaagaccaccacgctgtacgcgatgatcaccgagatcaaccacggcgtggacaagatcatcaccatcgaagacccggtcgagtatcaattgccgggcgtgctgcaaatcccggtcaacgagaaaaaaggcctgaccttcgcccgaggcctgcgctcgatcctgcgccacgacccggacaagatcatggtcggcgaaatccgtgatccggacactgcgcagatcgccgtgcaatcggcactcaccggtcacctggtgttcaccaccatccacgccaacaacgttttcgacgtgattggccgcttcacccaaatggaaatcgacccctacagcctggtctcggcgctcaacgcgattctcgcccagcgcttgattcgtttggtgtgcgccagttgcagcgcgccggtcaacccgagcgatgaagaactgcgcgcctcgggcctcgatccgcagaaagtcgatcactaccacttcgtccacggcaaaggctgcggccactgccggggcagcggttatcgcgggcgcacggcgattgccgagttgctgcacctcgacgacgaactgcgccagatgatcgtcgagcgccaaccgatcacccaaatcaaagccctggcctgcgcccgtggtttgcgcctgttgcgcgaatcggcgctggagctggtggaacaaggtcgcaccacgctggaggagatcaatcgtgtcacttttatcgcgtgagcgttttgtcgccgtgctcggcgccagcggtgttggcctcggtcagcggcgtggcagcgagaccctgtggctgggcagcgtcggttacatcgacgaaggcttccagagctacgcggtggcgctggacaccctcgaccgcctgctcggtgaacacgcccgcgccggggccgaattgagcgtggtcatctccgggcacttcagccgcttctgcctggtgccgtggagcgcgcagatcagcagccctgaggaactgcgcggctttgcccaactgtgtttcgaagacctgtttggcgcgccgacccagccgtggagtctggtgctgtccgctgaaccggccggttacgaccgcattgccagcgccttgccgcaagacttgctcgaacgcttgcggatggtggtcagcgctcgcggtttgcgtctgcgttcggtgcagccgtacctgatggcggcgttcaaccgcttcgacaaaagtctggatgccggcgactttctgttcgtcgtcgccgagccgcaacgcagcgtgttgttgctgtcgagggaagggcgctgggccggtgtgcgctcggtcggtggcagcgacagcgatgccgcgttgaatgccctgatcggtcgcgaacgccagctgcaagcttcgaccagcgagcgcgccttcagtgtttatctgcatgccccggcgcgcctcgatgcgcatccggacgtggcgggtgtgcaactgcgcacccttgaagacgcctcgatgaacgtgcgtgacggcttgtacgtcatgtcccgggcggtggcctgacatgcgcgcgctcaatctcgactttcagccacggccacgttcgggcccattgggttggagcctgctcggcgccggcgtgctgctggcgctgctgtgcttcggcgtgcaacagcacctcgacgcgcacaccgaacagcaacaaggccacctgcaaaccacccagcgccagctcaccggcgacagcggcgccaagtccaccctgagcccggcggaaacccgcgagcaagcggcaaacctcgccgaaatgcgcaaggtctcgcagcaactgcgccgcccgtgggaacgcctgttcgccatgctcgaagcgatgccgcgcgatgacgtcgcgctgctgaccctgaccccggatgcgcgcaaaggccaggtgcgcatcagcgccgaagcgcgggatctgcaagcgatgctcgacttccacaaacggctggaagccagcgacgaactgtccgacgtgtcgctgctgagccacgaaatcgtcgtcaaatcgccggaacaaccggtgcaattcaacctgtcggcgacttgggagattggcgatgcgaatccctagactgatcgtccacgaatacctgcaaggccttggtattccgggcctcgccggactggcgctgctgctggtcgccgtggcttgggcactcggcagtttgttgccgggctggcaatcgttgcagcacctcagccaacagactcaggaagccaccgcatacctggccaaggttgaagacggcagcatcgcgccgcccgtagtgccacaacgtcagctcgacgatttccgcaacaaactgccggcgcagccgcaagccaccgtcgccatcgaccgcatctacgctctcgcagcccaggagcacatcactctggcacgcggcgaatatgcactcggcgtcgatccgaaaacccatctggcgcgttatcagatcctgttgccagtgcgcggcagctacccgcaactgcgccgatttctgcacgccttgctcggtcagttgccagcggtggtgttggaagacctcgagttgcaacgcaagaagattggcgacaccgacctcaatggccggatccgtatgaccctttacctgtcgaggtcgtgatgaataccaagcgcgtgacagggtggttggcgttcttcggcgtagcggccgcgctggcgtggttgccggagtatttctcgccaagcgaagacgctggttcgaatgaagtcgccgtcgccacgccggggaaaacccggggcgcgctgccggccagtaccgccaaggccaaggatgcgtcgatcaaggacctgagcccggccggcgacctgttcgcggccaaatcctggaaggccgcgccgactctggccacggtcaccgaaatggccatcaacccagcaacagtggtgcaagccccgagcctgccaccggtgccgtttcagttcgtcggcaagctgcatgaccgcagcgacctgcaagtgtttttgcagaacggcgaaaagatctacgtcgtgcgcaacggggatgtgatcgacgacacctggaagatcaccggcatttccgatgtggaattgagcctggtctatctgcctttgcatttgtcgcagaccctgtctgtggggagtacgcaatgaaccgttgccgtttgctgatgagcctgggcctgtgtgccgggctggccgcgtgcagttctgcacaagtggccaacaaggaagccgccgacctgattgaacagggtcagtacgaggcgggtctggcccgaatcgaagaaggcctgcgcgaaaacccacgggacaccgagctgcacttgctgctcaacagcggtcgggccaaggcgatcacggcgttgctgacgaccggtgataccgaccgttcgcgccgcgacttcgcttcggcgcgggtggcctacaaccgcgcgctgaccatcgagccgaacaaccgccgcgctcaggatgccctgcgccaactcgactacctgcgcagcatggacgaaaaactcgaattggcccgtggcgacttgcgtcgtggcgacatctacggcgctgatcggcaggtcaaacagatcctcgaactcgaccccaacaacgaaggcgcactggagctgcaaggcaacattcgtctggtgcagagccgcaacgtcattccttatccgcaactgcgcaccaagcttgatcgcccggtgaccctggaatttcgtgacgccaacctgaagaccattttcgaagtgctgtcgcaggtcgccggactgaatttcatcttcgacaaagacctgcgcccggacatgaaagcgacgattttcgtgcgggacgtgcgcatcgaagacgccgtgaccctgctgctgcaacagaaccagttgcaccagaaagtggtgaacgaaaacaccttgctgatctacccggactcaccgcagaaagtgaaggattaccaggaactggtgatgcgcacgttctacctgaccagcatcgacgccaacaccgcgctgaacatggtcaagaccatgctcaagacccgcgacgtgttcgtcgacgaacgcctcaacaccctgaccatgcgcgacaccgaagacgccgtgcgcatggccgagaaactcctgcaatcgcaagaccagtccaacccggaagtggtgcttgaagttgaagtgatggaagtcgccacccagcgcatcctcgaccttggcctgcaatggccgaacaccttcggcgtggtcaacagcgacggttcggcggtgaccctgcttgatcaactgaaaggcatcaattccagccggatttcgatctcgccgtcgccgcaagccaagatcaacgctcaggacaatgacatcaacacactcgccagcccggtgattcgtgtgagcaatcgcgagcaggcacgcatccacatcggtcagcgcgtaccgatcatcagcgccacttcggtgccgtcgacgcaaggcccggtgatcactgagagcgtcacttatctggacgtcggtctgaagctcgaagtgcaaccgaccgtgcacctgaacaacgaagtggcgatcaagattgctctcgaagtgagtaacgccacgccgctggaaccgacccgtcagggcacgattccggtgcaggtcgacacccgcaacgcgcaaacctcgctgcgcctgcacgacggcgaaacgcagatcctcgccggcctgatgcgcaacgaccacggcgccaccggcaacaagattccgggcctcggcgatattcctggcattggccggctgttcggcagcaacaaggacaccgtcggcaaatcggaactggtgctgtcgatcacgccacggatcgtgcgcaacctgccgtatcagagcccgtcggacatggagttctccaccggcaccgaaaccagcatgcacatccaggcaccggatcgttcgcagagctacgtgatgccggcgcctgccgcgcagccgcgtgcagtcggtgaatcggccgtggccaccacccgcgtcagtgtcgagaagccttgatcatgaacgcctgccaacgcggtttcagcctgatcgaagtcgtggtgacgctggccctgatcggcctgttggcgagcatggccgcgccgctgaccgagaccctggtgcggcgtggcaaggagcaggaattgcgcaacgcgctgtaccagattcgcgatggcatcgacgcctacaaacgcgcgttcgatgccggttacatcgagaagtcgctgaacagcagcggctacccgccgaacctgcaagtactggtcgaaggcgtgcgcgatgtgcgcagcgcgaagggcgccaagttctactttttacgccgcatcccgcgcgatccgctggtgccggccaaacgtgatgacgaagggggttggggcgtgcgcgcctacaacagttcggctcagaacccgcgcgatggcgaggacgttttcgacgtctattcccacgcccggggcaagggcctcaacggcatcgcctaccgcgagtggtgaacctcatgcgccgggaaaaaggttttaccttgctggagctgatggtggtgatggcgatcatcgccacgctgatgaccatcgcactgccgcgctacttcaacagccttgatgcgtcgaaggaaaccaccttgcgccagagcctgtcggcgatgcgcgaggcgctggatcacttttacggtgacaccgggcgctatccggattcaatcgagcaactgatcgaacagcgttacttgcgcaacgcgccactcgatccgatcaccgagcgcaaagaccagtgggtgctgatcgcaccaccggacggtgtggcgggcggcgtggccgacatcaaaagcggtgctaccgggagggcgcgtgatggcagccagtattccgagtggtaaccgcgcgcagcagggtggtttcacttacctgggcgtgctgttcctgattgcggtgatgggcatgggcctggccagtgccggcgagttgtggtcgaccgcttcgcgccgcgaccgtgagcgccaattgctctgggtcggcacccaatacgcccaggcgctgcgcagctattaccgcagttcgccggggctggcgcagtacccgaaagagttggcagacctgcttgaagatcagcgctttcccgaggcgaaacatcatctgcggcagctctatccagacccgatcggtcagggcgagtgggcactgcaacgcggtttcgatggccgcatcaccggcctcaacagtccctcgaccgagctgccgttgaagcaggcggacttcccgacgcagtggtcggatttcgacggcatgcagcgttattcggactggcagttcgtggcagaaaaggcctttctcgacggcactggcactagtagcgggggcccggccaaaggccagtcgaatttgccccaggcgttgcagccatgactcgccactggtggtgcgcgctgattctcaccgtggtggcgtgctgcgcccatggcggtgaagaagacgaaatgatgggcttcatcgtcgatgacacgatctcgcacattggtcacgacttttactactcgttcagtgaacgcctgcgcgacaccagcccgatggatttcaacctggtggtgcgcgagcggcccgacgcgcgctggggcagcctggtgaccgtggaatatcagcaacgcctggtttatcggcgcttcctgccgccgaataccgtggaactgaaggacgaggcctacgcggccgccgactgggttcgacgccaggttgtccagcgcaagctggaggctctgttgcaggacaccaccgaccttgagaaggacgaactatgaacagcacaacgttctcacggcgcagcggattctggatctcggggttgttgatcgggctcgccagcgctgccgctgtccaggccactgaactggtctacacgccggtcaacccgtcgttcggcggcaacccgctcaacggcacctggttgctcaacaacgctcaggcgcaaaacgatcacgacgatccggacatccagagccgttcggcggtggccgggacatcggcactggagcgcttcaccagtcaattgcaatcgcggctgctagggcagttgctggacaacatctccaccggcaacacggggagcctgtccaccgactcttttatcgtcaacgtcatcgacgactccggggcactgagcattgaagtgaccgatcgagcgagcggtgaggtttcggaaattcaggtgaacggcctcaacccatgacgggctgacggttccggggagaacggacatgaaaaagatcatcgcgttagggctgctgttggcgacattacaagggtgcagtctgcgtgagccgatgtcggccgagcaggacaccgaaaccccgaccctgacccccagggcttcgacttattacgacttgctgaagatgccgcgacccaagggccggttgatggcggtggtgtacggcttccgtgaccagaccgggcagtacaagccgacgccggcgagttcgttttccaccagcgtgacccaaggcgcggcgtcgatgctgatggacgcgatgcaggccagtggctggtttgtcgtgctggaacgggaagggctgcagaacctgttgaccgaacgcaagatcattcgcgcctcgcagaagaagccgaatacgccggtgaacattcagggtgagctgccaccgttgcaggcggcgaacatgatgctcgaaggcgggatcatcgcctatgacaccaatgtgcgcagcggtggggaaggggcgcggtatctggggattgatttgcagcgtgagtatcgggtggatcaggtgaccgtcaacttgcgtgcggtggatgtgcgcagtgggcaggtgctggcgaatgtgatgaccagcaagacgatttattcggtggcgcgcagcgcggggattttcaagttcatcgagttcaagaagttgcttgaggctgaggttgggtacaccacgaacgagccggcgcagctttgtgttctgtcggcgattgaggcggcggtggggcatatggtggcgcaggggattgagcggcatttgtggcaggtggcgggggacagttctgtgcctgggcaggatgatgtgttgaatcggtatttgacccagaacaagattgatccggatgctgagtgaggtttttgctgttgagcttggcggcctgatagccgaccaggctctctcggtcgaaaccggtttaaacctgtaggagtgagcctgctcgcgatagctatctctcagacacagttgctattgcggatgtaccagaatccttgtgggagctggcttgccagcgatggcggccttatagccgaccaatctctggcggatgtacccagttccaattgtgggagccagcctgctggcgatgattttctggctggctgagtacatatccattcctgcggcaacggctgcttagggtttcgcccttacggcgactcactgtttttacaagcgccaaaaaaaagtaagcaaaaaaacgcttgctcctacgttcggcccgctcgctaaggctcggggttccttcgctccgggatcgatccgggcgcagcgcctacggtttgcttcgctgcacctcctctcgctgtgtttggctgcgccaaacggtcgctgcgctcccacccccggatcaatccctgcgctcagcctgccgacgtcgctcgtggatcaagatcaagagctgcagccgagcttgcgctcatcctgcgagtggggcggctgcgccgcgaatttcatgtaggagctgccggaggctgcgatcttttggtcttgcgtttgtaggagcaaagcttgctcgcgaaaggcggtgtgacagccaaccaatccctcgcatgtatacctttctcggtgggtgctggcccgccagcaatgacgaccccaacttccccaaacatttggatctccaccctggaatgttaggctccccccaatccctgcattctgtgaaggaaggcttatgttgaaggtgttcgctctactgacgctgctggtgtccagcgccgtccaggcgcaaaccacgctgcaatccgatctcccattgaagtacctcgagcaggttcatccggacgcggagccgcgtccgttggtgattttcctgcacggctacggcagtaacgaagcggatctgatcgggatgaagttccagctcccggcgcagtacaactacttgtcggtgcaggcgccgctgtcgttgggcgaggatcgctatcagtggtttcgcaagaagggtgagggcgcttacaacggtgagacggatgatttaaaggccagcgggcagaagctgcgcgacttcattgcgcaagccgcgaagaaatatcacgccagcccggacaaggtgtacctgatcggcttcagccagggcgcgatgatgacctacgaagtggggctgcgaccgccgctggccgtgggcggcatcgcggcgttgagcgggcgtttgttgccggtgttgaaaggccagctcaaggccgagcaacaaccgctgccgctgaacatcttcatcggccatggtaccgccgatgatcgcgtgccgtaccacgacggtaccgaggccaaggcgttgctggagaagctggcttacacaccgcaattccatgcctatccaggtgtcggccacagcatcactgcggccgaactgcgggatttgaatggctggttgcagcagctcaatccttgaggatggtttttaccagggcatcgtgacctttcttgtcgctggcgcgggagatcacctgaaccagcgccattttcgtgccggagccggccagcagcgtggtgttgagggtctggccgccgccttgggtggcggtgctgtcgacttgacgcagaccgaggccggtgcctttctgggtcagacttttctccgtgagcttgttgaaatccggcaaggctttgcgttggtcttcgatgaagctcgagacgctgccgtcgagaaattcgccgtcattgtccttgacgttctggccttcaggaatctggttttcggcggcgatgaccacggttttggtggactcgttggtgtacatcgtgccggtggcgccgccggggctggccggtaacggatcagccacgaagcctttaggcagagtgaaagtgaacttgccgccgagcagcgagacttgctcggtcgtggctttttccttggctttggccgcctgagcgttgatggcgccgagaccggcgacggccgccagcaacacgatgacggctttcttgctcaacaatgacattcgaatctccgagggatggacgcgctaggtgggcgatcatcccacgcagcgtgctgtcactccagcgcggttcgtcagggttactgtgcctgctgctgtttcgccaccggccggaccagcaattggcgggtcacgccgagcatggccacggagaccgccacgccgaccgcgaatccgctcagtcccagggtgggcaaggtcaatgccgccaccaggcagaacgccgaaaacgaatacatccccgtcgcggttgcccgtaacagcacggcagtaaacgccgggccacgggtttgctgggaaaacaccgccatcacgctgccgagcaccgggaacaccgcgagcagaccgctccagcgctcgccgacggtactggccagcatcgtcaccaccagcgtcagcgcggcgccggcgatcatccgccagatcagtttgtccgacttcggcgccgggccgttgagcactggctgtaccttaggaaacaggtaaggcgacgaaagcagagcaatcgcggccgccgccacagagaacggcaacgacgcgggaacgagcgacaacagcaacgccagtacgccccagaccgccagcgaaatcgtcagcgcccacggccagttcgcgcgctgtgcgacctgcgcataggtgatgcagaaggcaatcatcgcgaacatcgccgataacgccgccaccgctgagtgagcggcaaacgccggcccctgctcaatggcgaggaaaaacagaatcggcccgaccaccaccggcaacccggacagccacccggccacgcttggcccccaacgcttgcccgcgagggaaatcagcagcagaaaaccgggaatcaacagcagtttgaggatcagcacgcagggggctccgtcaggtgatgacggccacgttagcactgccgatcagagattgctgcaaatgtgttcgtattttgtatacaacatccgcattgcaatagccgactatgctctgactatcagagcttgctggagtcgataccgccatgaacagagcgccaaaagtgttacgaggttgttgtggcatcggtttgtgggcgttgttgctgacaccgacctgggccaactggcaagacgcggtgccaggtgcgcagatcatcggcaccggcgatttcagcgtattcggattcgatgtgtacaacgcgcggttgtggagcgccgcccggcctttggctgacggtcagccgtttgccctggagctgatctaccgccgcagcatctcccgcgaggatctggtcaaggccagcgtcgacgaaatcaggcgtttgggcggcgccaatgtcagccctgtgcaattggccggctggcagatccagatgcagcaatcgttcattgatgtgcaggccggcacgcggattaccggggtgtatctgccaggtcagggcgcgcggttttttgtcggtcagcagttgcagcatgaaatcgatgatccgcagtttgcccgggcgttcttcgatatttggctggatccgcgtacgcgcagtcccgagttgcgtgagcagttgttgggtgtcagtcgatagattcttttgcgcttcaaggcagcaactgaaacgtctaagctgcatctttccgacttgtttcaggatgtgtgcgtgaaattcagtttgcccaaaatcgccaccgcgccgttttgcccaccggaagtggccggcagcgtcgcggtggatccgaatgcctcgttcttcaaacgcgtgctgcgtttcgccggcccaggattgctggtgtcgatcggctacatggacccgggcaactgggcaaccgccatcgaggccggttcgcgatttggctacagcctgttgttcgtggtgttgctggcgagtctggcgggcatggtcgtgcaatgcctgtgttcgcgcctgggcatcgccactgggcgcgatctggcgcaactgtcgcgcgagcgctacagcacgccgaccgcacgtttgcagtgggtgttggcggagatctcgatcatcgccaccgaccttgccgaagtactcggctgtgcgttggcgtttcacttgttgctcggttgctcgctgaccttcggcattgccctgacggcgttcgacacgttactggtgctggctctgcagaaccggggcttccgccgactggaggcaatcatgctggtgctggtcgccaccatcggcgtgtgtttcttcgttgaactggtgctgatcaagccgtattggccggacgtgttcagcggcttcaaaccctcgttgtcggcgatcagcgatgctgcgccgttgtacctggccatcggcattctcggcgcgacggtgatgccgcataacctctacctgcacacctcgattgtgcagacgcggatgatcggcaaggatctggccagcaagcaggacgcggtgaaactcgcgcgcatcgacaccatcggttcgctggcgttggcgctgctggtcaacgcggcgatcctgattctcgcggcagcggcgtttcatcagtcggggcataccgacgtagtcgatatccaggacgcctatcacttgcttgatccgctggtcggcggggcattggccagcgtgctgttcggcgtggcgttgctcgcttcggggcagagttcaaccttcaccggcaccatcgccggccaggtgatcatggagggttatctcaacctgcggattccgtgttggcagcggcgcctgatcacccgtgggctggcgctgattccggcgttcatcggcgtgtggctgatgggcgataacgcggtgggcaagttgctggtgctgagtcaggtggtgttgagtttgcagctgccgtttgcgttgtacccgctgattcgcatgaccaatgaccacaagctgatggggccgttcgtgaatcgctggccgacgcgggtgttggcgtgggggttgtttgtggtgatcagcggggcgaatgcctggttgattttgcaatgggctggctgaatttttgcggtgtctgggctggccccatcgcgagcaggctcactcctacaggatcgggttcacaaatcccttgtaggagtgagcctgctcgcgatggcgtcaaaacattcaacaaatatttcgaacagacaaaaaacacccggtgcaacgcaagctgcaccgggtttttgttgccagcaaccagcggatgtcgtggatccgccgtctgccgttgaactcgatatttaaacgcgttccagcgccagcgccacaccctgaccgccgccaatgcacagagtcgcaagaccctttttcgcatctcgcttgatcatttcatgcaacagcgtcaccagtacgcggcagcccgacgcaccgatcgggtggcccagtgcgatggcgccaccgttgacgttgaccttgtccagatcccattgcagatccttggccaccgccagcgattgtgcagcgaaggcttcgttggcttcgatcaggtcgagttggtcgatgttccagccagccttgtcgaggcagcggcgggtggccgagaccgggccgatgcccatgatcgccgggtcaacgccggcgttggcgtaagcggcgattttcgccagcactggcaaacccaaggctttggctttttctgcgctcatcaggatgactgcggcggcgccgtcgttcagcgacgaagcgttgccagcggtgacgctgccgtccttcttgaacgctgcacgcagtttcgccagcgattgcgccgtcgtgtcgccacgtggctgctcgtcgaccttgaacgcgaccggatcgcctttgcgctgcgggatcaggatcggcgtaatttcatcgacaaagcgaccggcctcgatggcagcggcggctttctgctgggaagcggcagcaaaagcgtcctgctgttcgcgactgatctcgtacttgtcggccagattctcggcggtaatgcccatgtggtaatcgttgaacgcatcccacaggccatcgctgatcatggtgtcgacgatttgcgcgtggcccatgcgcagaccggtgcgtgcgcccggcatcacatagttggacaggctcatgttttcctgaccgccggcgatgatcacgtcggcgtcgccgcaacggattgcctgtgcgcccaggtgcagagccttgaggcctgaaccgcagaccttgttcagggtcatcgcgggcaccgcgtgtggcaggccagccttgattgccgactgacgtgccgggttctggccggcaccggcggtcaacacctggcccatgatcacttcatcaacctgcgcaccgtccagaccggtctgctcgagcaactggcggatcaccgccgcgcccagatcaacagcggacacgctggccagggaaccctggaaactgccgatcgctgtgcgcgtggcggcaacaattacgacgtcttgcattttcgaattcctcactcggcagcgaactgcatttccggtacgtgatccgggacgatcagtttaccagcggttttggcgacgatttcctcgacgctgacgccaggtgcgcgttccttgaggacaaaagcgccattttcgatttccaggtaggcgaggtcggtcagcacgcgcttgatgcaaccggcgccggtcagcggcaggctgcatttggacagcagcttggactcaccgtccttcgaggcgtgggtcatgatcacgatgatgttgtcggcgccagccaccagatccatcgcgccgcccatgcccttgaccagtttgccggggatcatccacgaagcgatgttgccctcgacgtcgacttcgaacgcgccgagcaccgtcaggtcgacatgaccaccgcggatcatcgcgaaggattcggcggagttgaaaatcgacgcgccgatgcgcgcggtcacagtctgtttgccggcgttgatcatgtcggcgtcgatggtctcttcagtcggaaacgggcccatgccgagcaggccgttttccgattgcagcatgacttccatgccttcgggaatgtagttggcgaccagggtcggaatgccgatgccaaggttcacataaaagccgtcctgcatttcgcgggcgacgcgctgagccatttgttcgcgggtaagtgccatgttgttattctccgtcagcctgaattatttgcggatggtgcgctgttcgatgcgtttttcgaacgtgccgcaaatgacccgatcgacgtagatgcccggggtgtggatctgcgaggggtcgagttcgccgggttcgacgatttcttcgacttcaaccacagtgatcttgccggcggtggcggccagcgggttgaagttctgcgcggtgtgacggtagacgacgttgccgaagtggtcggctttccagcctttgacgatggcgaagtcgccggtgatggattcttccatcaggtacttgcgacccttgaattcacgcacttccttgccttcggcaaccggggtgccgacacctgtggcggtgaagaaggccggaatgccggcgccgcctgcgcgcatcttctcggcgagggtgccttgcggggtcaggatgacttcgatgtcgcccttgagcagttgctcttcgaacagcttgttttcgccgacgtaggaggcgatgactttgctgatctggcgatcggtgagcagcacgccgaggccgaaaccgtcgacgccgcagttgttggagacgacggtgaggtcgcgggtgcctttgcgtttgatctcggcgatcaggttttccggaatgccgcacagaccaaagccaccggcgatgacggtcatgccgtcctcaagcccggccagggcttcctcataggaactcacgcgcttgtcgaaacctgccatatgcacctcttttattatttgcgggcggctggctagccgaatgattggagtgtctcgctggaggatatatttgttaagttgatttttaaggttgattgattgataaagctcaataatcgcgttatggcttgccgcttaacgcttgatcgttcccacgctctgcgtgggaatgcctctagggacgctccgcgtccagtgacgcggagcgtcacgggctgcattcccacgcggagcgtgggaacgaaagtgcgcaagaagttgcgcagtactgcgcaacttcttgcgcacttggctgcaggccaggataggcctggcctgcagcggatttaagggcgaaatattacgagcatgtgcgcaacttcttgcgcagtatggcaataggccgcgccgggtatttgaaggcgtcaaacttttcgcgcccagcttgcgaacatcacatcaccgacgtacacgcctgaagaggctgaacgttcctgatccagacgctcttgcaacgtttcaattccgacctcttccgcgctggcgacgcctagtgcgaggattcgcggcaaacaccctcgaacaatcgcgccaaggctgtaggggctatcaggggtttgtatcaggcattcagcgcgcacgctttctacggtcaggcctgcctgagtgaaaatacggtggagattgaaaccgatgtgtaaatccgcgccttcgcgagcaatcatttcctgtatccagaactgcgcttttttatgcaacgggaaagggtccatgcttgcaggcgccatcgtcgtatcgtgttcttgaaagaccatgacgccgccgggacgcaagcggttcgacagcgctcggatggtcgccacagcatccctttgatacatcaggacgcgcctcccgacgatggcatcaaaagtaccaagcgaatcctgcagttccagaagctcgcactggatgaacgttagtgaagggtaaccatgtgcggcgctacgctggcgtgcgatggcaatggcatgggcgtcatgatcaacgccgacgacctctccattccctcccgccagatcgcacaacaaaacagaaacatcacccgagccgcaacccacgtccaggattcgcatcccttttccgatgcccgcgtcgatcagcaaacgcgtggtgaagtcgagtcggttgatcgacattactaagcctctctgaatgttctgaaaagtctatggtatgcactttggccaacacgccgcttgagatcgatagcacccgtcgcgaacggcggctctcgacctcaaggatcaggcagcacccagcattgcttcatccttcgccaccgcacggttaaaggcgtcgcggctcgttaacttctcggcgtaagcgaggaacgcagctctgggtggcaaggtttgcaagcctagtccccagccgatgtgggagccaacataaacatccgcagcggtgaagtgttcaccggcaataaagggatgcgccagcaccgcgcgttcgagctgatccacggtgcgctcatagcttccgtagccaaagaaaaactcctgttccggcttcgggttgaaaccggcgcggtggttagtcaccgcctgttccagaggccccgcagcaaaaaacagccagcggtaataagcggcacgatccaccgccgcaggagccagcccggcttcgggaaatgcgtcggccagatacgcacagatggcggcagtttctgttatggtttgcccgttatgcaccagcgcggggatctttcccatcgggttcacgtcgcgaaaaaaaccgacgcgtgaatcatcagcatcggccagcgtcggcgcggccagcgcagcaccaccccaacggtcagcctgactgatcgactggtaatccataatcaccgtctcataggtgcagccgatttcttcgagcatccagcgcaccatgcgtccgcgtgaattggggttggtgtagaaagtcattgtcatcgtgagctccttttggctctgtttgttgacgacaatggtaagagcgaagctgcatcagcccgtgggcggtttacgccagaatacttgcggaacgcgccattagcggcgcgtagcattacgcattgccgccctcctgcggttcggagcttagaaatgtcgcaccttcacaccagcgccgaacggtgtaaattgccccgggtgttctggcagtcgatagagcaactgggcctggatccctcgttgattcagcagcacgctcaactgccccatgatcttcaccttaacgagtctgcttttgtcagcacccatcaactgtttgccgtctggaacgccatcgaagtgctttcggcggatcctgccttcgcgataaagatggttcgcgacacacctagcgcgaaacacaaactggcgttcctcactgcgttatatgcggctgactttcgtgacggcctcgctcggttggcgcgcttccagcgtctatgtagccccgacaaactttgcatcgacgagcgcgagggcactgtttcactcacgattcagtggccttccggcacggagccggcgccttatctttcagtcgaggcgtgttttgccttggcactggaactcggtcgacgaggcaccggcaaacacattgagcctctgtcattgagcttgagaaggccccagcaaatgctggaaacgcactcaagttatttcgcctgccccattctctacggcgctgccagggacgaattgatccttcgcacctctgacatcggtctggcttttcttgagcacaatccggaagtgctgcacatgatgacccccggcctcaccgccgcaattcgcgcgattgaagcgccagttggcttttgtgagcaggccattgaagtgctgaaacgcgcactggcgggcgggcggccaagtttgcaattcctcgcccgtgaactcttgcagagcgagcgcacgttgcaacgacgattagcgtgcgagggtacaacgttcagcgctctgctcaacgaggcccggcgccaggtgggattactcctgttggctgatactggccttgagctgaaagaggtggcgtatctgcttggctacgaggacgtcaactctttccatcgggcttttcggcagtgggaaaagatttcgcccgctcagtggcgacgtttcaatgcctgaagcatggcgctggccataggcgcaaaggcatgactgcttatggccgaagacctcgccgcgacggctgagagttcctgtggcaagaccctgcctcggtcaaggacgccgatgcttggcagcgtctttggtttgaactggagatcatcaacgggcttgcgttggcgcaatgggaagatgagggaaagccaggtgactggtcacgcagctggagcaaagactatcgacaagaagcggccgccctggcgactgaactggtagcaatgcttggcgatgcagattcatctgccacctgactggcggtgcccgcggtaaagcgggcaccgtttcctgtgtgggaaaagggctatacgcctgcttaccagttgtaactcactttggcggtaatctcgcgacccggattgtagaagttcgctgtgccggaaccgaccacgtgctgctcatccagcaggttgctgaggttcaccgcaaggtcggtgcccttggcgatcttgtagttgaacgcggcgtcgaacagcgtggtgccatcgcttttgccagagttggctgcatcgaagtagtaagagccgacgtagcgcgcacccaagccaacgctgacatcagtggcaggcacgtcgtagtaactccagagcgaagcggaatgcttgggtgccgtggcgaactcattacccttcaaggagctgccgtcgtacaacgagccgcgctgtacctcggactccatataggaataaccaccgatcaagctgaggttctgcgtcacctgcgccttggcttccaggtcgaggccacgcgcccgcgactcgcccaccgtctgttgctcaatgatgccgctcggcagcaccacggcgatggtgacgttttcctgggtcaggtcataaacggctgcggagaacagcgcgtcgatcgccataggcgaatacttcacgcccacttcgtactgccggcccgtctgcggtgttacaccaacctgcggcggcgagacggattccaccatgctcacataggtggacacctcatcgttgacgatataggtcaacgcacctcggtaggaggtttcggagaaggtgtctttctcagtggattccaggcctttgctggtcaggtccatcgagtcgttgcgcacgccgccggtgacgatgaaccgctcgtagaacgacaggttctgctggaggaatacggccttggtggtcgcgtctcgcttgttcacggcatacggcgcgattgagcgtgaaacgccggtaaacacagggtttgcaatatcaatggaggtagtcggagcgtagaccgagctttccttggtggtcgaatcgaggtactcgacgcccaccaggctgctgctgtcgatgttctcgaagcgggcatcgtattgcagcatcagattgccgttgaactggtcggcttcggtgtccgttccaaactgatagcggtcaacgatggtaccgacacgtgcggcgctgtcgctgaggtaaacgtagccaaaatcatcggtcaacttgctgtaacgcagattgctgcgcagtacgaagccgttgtcgaagtcatgggtgacgttgccgctaaggctggtgcgctcgacatcgtgaaagttgtagctgggctcaccataaaacttgctgcggtcgtattccctgtccagcggatagccaccgctgtttggcgaactttcggttttcaggtagtccagaatcatcgtcgccgacgtgtaatccgtcggtgcccaggtgagcccgcccataaacaactggttgtcgtcctgcgagtggtcgtattcgcggtcgctgttttggcctttggcagtaaagcggccagccagggttttttcgtcgttcagcgcatccccgacatcgatgcctgtctcgacatggtcaaacgaaccgtaggtcacatagccttggccaaactgctcgaagcgcggctgtttggtcacgaaattcaccgaaccgcccgggtccgccggtccaaatagcgtggagttggcgccacgcagaatctcgatgcgctcgtaagcgaatggatcttcgcgtacgccgcgcatcgaactcagggtcaagccgtcacggtaagtggtggcctggaagccacggatctggaagtagtcgttgcggtcatccgtaccatagaagtcagtgatcacgccgggtgtgtattgcagcgcttcttccgtggtgctgacactgcgctgttccatttccttgttggtcacaaccgacaccgatgccggtgtattgagaatgctggtggccactttgccgccaacccagagctccttggcgaccaccgagttggcgtcgtcgtcggcactgaccctgaccttggcgttgatgatgaggggcgcaaggcggtagtcctcgacgtcggttgcgtcgagttcgagcgggccggcaggctttggctgaggtgtcagcaggtaagcggtcgagccttgctgctcgatctgcaattggctcccctgcagcaacgatgacagcgctgccgacgtatcgagcgagccattcacgccagcggtggtgcggttcgcaacactcgacgcatcgaaggaaagactgatgccagcctcacgcgcaaagcgatcaagcgccggcgccagtgggccggcagcgatgttccactgcttgacttgattgctgtggtcagcgctcgtcgtttgccccagcgatggcaatgcgtagctgctgacaatcaaacccaacatcgcaccttgcaaggcacgatttaatggatggcgctgtgaaaccggggacgaactcattttctcgctccaagaaaggacatcggcagactggcctgtattccggccttcctaagaggtcgaacgagaatgcgaaaccacctcattatttttcaggtggttttgatgggctcaggcagcagcggtcacggtcacccagtaacgggttcggtaatcgatgtgcaagcgcagtgactgcgcgatcaatgccaggacctgatcgttgtcggcgagctggaaggtaccggaaacgcgacgatccgcgacctcttcggcacagcgcaataccccgggacgataacgcgacaactcgacgatgaaatcatcgagacgcatattgcgcgcactgatcactccgtccccccagctccacagatcgaggccgttgtcgctgaacgttcgggcgccactcgatgtgaacagcagctgattgcctgcctggacgctgcggctcgcaggcgtttgactgaagccggggaaaaccgtgactgacccttcctgagccgcgaccagcgtgccatcgtcacgttcgcgtgccagaaagcgcgcactctgagcgcgcatgatcccgtcacgtgattgcacccagagcggtcgcgcttgaggcgagtgttgatcggcgccgacattcacgatgatttcaccccgtcgcaggatgatcaggcgtcgctgggcgtcgaaatcgctgtcgacggcgctatcgctattgagctggataaggctgccatcatcgagttggaagcgtcgttgctcgccggtgctgctgcgttgttgcgcaagcatggcgggaacgggtgtgtagtcgcgaccgagccaggctgccgtgccaacagtcgccaataggcccagtagcttcaggctttcgcgccggcgcattccctgatgggtgccattaagggtttgtcgcgccagttgagcgggtacgccggcaaattcatccccaagggtttccacacgctcccacgccaacacatgctctgggcgctgctgcagccagtgctcaaaagagtgctgtgtttgttcatcggcctgattgaagcgaaggcgcaccagccattggatcgcctgctcaacgatggccggatccagcgcctgcggctcaggcctcgacataacgcaagcgatagcagtgttgcagggccgtggccaggtcgcgctcaatcgtcgcgcgggaaacaccgagcttttcggctatttgcgcgcacgtcagaccgtcgagtcgggcacataaaaacgcctgacgaacccttggtttaagcaaactgagcatgcggtctatgcgctcgagcgcatcaagaatcagcagccggctttcttccgagggaacctcgtgttgaggcagcaacgtgacgctttccagataggcacgttcgagttcgcgacgacgatactgatcaatcatcagtccgcgggcgatgctgctcaaataggcgcgcggctcgcgcaaggggctggactgacgggatttgagcagacgtacaaaggtgtcctgcgccaaatctgctgcgttatcgcgacatccaatgcgtcggatcagccagccgtgtaaccacgagtggtgggtgcgatagagcagccctagatctgcagtacctagcgtttcgtcgctgcgcatcggaatcccggaaagtacacaattgataattaatcgcattctactcacgggacagggccggaggcaaatacgtggcgctcagcgttcggatttgggcgaatggggtcattctgaaggggggcgagtggaaggatgcgtccagcgattggaagatttgaaccctggcgattagcgtgaacgtaaaggtttcaggagggatgcggacccgtgtaatggggcagcaggggcgggcggtggagtcttggtccgagccgccggcattgagcatggtaactctacgatgcagattttctactcgggtgatttgcctaacccactgcgcagaatgctcccacgccagaaacgacaaagccctgaataatcagggctttgtcggtacaaaatatggcggaggcgatgggattcgaactcatggacctgttacagtcgacggttttcaagaccgttgccttaaaccactcggccacacctccgttgcgttgcgggcgccataatacctgaatgaaacacactgtcaaactctctgcatggcttgttacagagcgtctgttatgatctttgcgactgaacgtttcaaaccaacaggagtgtcgccatgcgcgaacaggattacgcagttaataacggcgtgcaggctgagcagctagaggttagccgcgtcctgcgcaacacttacggcctactggctctcacccttgcattcagcggtgtgatggctttcgttgcccagcagatgcgcgttggctacccgaatattttcgtggtgctgatcggcttctacgggttgttcttccttaccaacaagctgcgtgattccgcgtggggcctggtgtccgcattcgcgctgaccggtttcatgggtttcctgctcggcccgatcctcaaccgctatctgggcatgcagggcggcgctgaagtggtcagctcggcgttcgcaatgactgcactggtgttcggtggtctgtcggcctacgtgctgattacccgcaaggacatgagcttcctcggtggtttcatcaccgccggtttcttcgtgttgctgggagcaacgctggcaagcttcttcttccagatcagcggcctgcaactggcgatcagcgcaggtttcgtgctgttttcgtcggtgtgcatcctgttccagaccagcgccatcatccacggcggcgagcgtaactacatcatggcgaccatcagcctgtatgtatcgatctacaacctgttcgtcagcttgttgcagatcttcggcatcatgagccgcgacgactgatcgcagtctgtgaaataacgaaaaacccgcctaggcgggttttttgttgtctgcgtgaaagtgttgaagccatgctcggctagttgatcacgatgctgccgtcgacctgctgcttgtagatggtgtagggcagcagaaaagtatcgagtgccccggatatcaccgcatcgatcaacaccacaggaatcgcggcgtttttgtagtcgtcggcctccacgccttcgcccagaggggcatgcaaactgcagaaatcgtaggcgaggccgctgtagattcttggcaccgccccgcaataactcttctgtttcttgaggctgtccaccgcggcctgatcattgcgcaccacggtttgaactgtcccgcaaccgcctagcatcaacgccgccagtatcattgcctgaattctcattgccgccaatccttcgccggaaaaacctcaatctacgccgaacatgctgaaaaagcacttacgccatcggcggcaatcggcgtttgaccggtgtcttcttgacaatcgcagtattggtttccgccagagtattgagccggtcgagaagggtgtccagttgctccatcgagcgcacgtgcagacgggcgataaagcagtcctcgccggtgaccttgtcgcactcggtaaactctggaatcgccagaatctgccgctccacttcctgcaattgccccggcagtggccgcacgcgaacgattgcctgtagctggtaaccgaagcatttcgggtcgatttcgacggtataacctttgagcacaccacgctcttcaagcctgcgcaaacgttcggccacgctcggcgaagacaacccgctcagctgtgccagcgccttgagcgagcgccgcgaatcttccatcaatgcgctgatgaggatctggtctatatcgtctgtcatgagctgattccaggattaggccactgagggaaaccaccctcgataaaaaaggcaaaaattaagtttagcctgctttttactctggagaacaggtggttgggcttgacatacttttgtcacgttttcagcaaatgctcaggagattgatgatggacaacccaatccgtcgcggcacatttgaaatgactgcggccatgcttatctctgggacgatcggctggttcgtcctggtgtccgggcaaccggtgctcgacgtggtgttctggcgctgtgtgttcggcgcaggcaccttgctgctgatttgcgcggccttcggctttttgcgtccgggtatcctgacccgcacgacgttcttgctggcggtgctcagtggtgtagcgattgtcggtaactgggtgctgttgtttgcttcttattcgcgcgcttcgatagccatcggcacggccgtgtacaacgtgcagccgttcatgctggtcggtttggcggcgctgtttcttggcgagaaaatcaccttgcagaagctgttctggctggcgatttcgtttatcggcatgctggcgattgtcagtgcccatggtacgcaaggcgagggcggcaacgactacctgctgggcatcggcctggcattgggcgcggcgttgctctatgcgattgcggcgctgatcatcaagcgcctgacgggcacaccgccccacctgatcgcactggttcaagtgtgcaccggcgtgttgttactcgccccgtttgcgcacttttctgcgctgccgcaagtccccggtgcctgggccagtctggtgacgctgggcatcgtccacaccggcctgatgtatgtgttgctgtatggcgcgatccagaaactgccgacggcgttgaccggtgcactgtcgtttatctacccgatcgcggcgatcctcgtcgactggtttgcctttggccatcgcctggaaaccctgcaatggctcggggtggcagcgatcctgctggcggccgccggcatgcaacaggggtggggcgtgaaatcccgggccgcggtggctgcgcggccctaaatggccttgatcagttccttgaacagacctttcaactgttggttaccggcatccaccaaatggttgtcatcgaagtaccaggccacgccgtccctggaccccatacaagtacctgccgggcaaaggtacggcgtcggatcgatcaccgttgcatggcagcgtttggcggctgcctcaatggtgtagttggcgatcctgttgcgtttttcatactcgctcagcgtgatcgaaatatcggcgttctgccggaacaggcgttgattaagattcaggcctttgtagacgctgaagggcatttccgggatcggcctgacgatgtaaaccgggtggttttcggcaatcgagcaaacggtcttgctgtattcggcgatgtaggcgtcgacaaaagctgcatcgccagaatgcgcgctgcccggaaagtgaatgcggtaattgttgcttctcccgggatcggcatacagcgcggcgcggctgaacagcactaccggaacgcccgggaagtcagtcttcaacacgcgcagcttttcatcgttgaaggcgcggcatttgtcttgcagatccttgtcgcgcatttcgaagttcagcaagggcgggcagccgccgcgcgaccaggacagtgcggcttgcggattactcatctgtacggcggcagcggtggattgcgcgtgactgtcaccgaacagaatcaccgagatttcgcctgtgcccaatttgcagtcagccgcagcgtagcggttgggatagcactcttgtggatacagtttgctggtgtattcgggctgaccgaggtcgacaaatgccaggcgggcatccgggtattgcttcaccagcgaggaggttgcggccgaaaaaccgatgacgccgacgatcagcgaggcaaacttgaacagtgtgcgtggtgcggtacttgttctgctgaccttcgattcgacccagtagtaggagacggcgccgagcaacagtgaaagagcgatggcgcccagcacatgcggccaactgctcaacagtccgcacagatacagaagcaccaccagcggccagtgccagagatagacggagtaggaaatgctgccagtgaattgcaggatttcattgcgactgaagagcgactggcggttgctgtagatcaccagcagggtaccgatcactggtagcagggcgagataacccggccaaagatcttcttccgaaaaatacgtaacgctgagggcgatcgccaggagtccagctccctcacacagcgcactgttgcggcggctaagagccagaggaaaaacaaaggccagaccgccgacgatcatctcccaggcgcgggtgggcagcatgtaaaaggcaaaaaccgggtgggttttactcaagtaaaccgaagcaccgagcgagatggccgccagcacgaccaaggcgattttgcttgtgcgctcgccacaatatttgcacagccccatcatcagaagggggtaaagcaggtagaactgccactcaaccgacagcgaccaggtgtgcagcaaccagttctcgtgcagcggtgcgtcgaagtaattgccgtctttggcgaagaggaaattggaactgaacagcaggctgctcttgatcgtgcgaatcgtctcgcgaaaatcatccagcggcaggtacacgtagccgaagatcagcagcgcgatacacagggtcagcagcgccggaatgatgcgtcgggcacgagatgcatagaagccgagaagggagaagtttcgttgctgcaaacccgtgacgatgatccccgtcatcaggaaaccggagattacgaagaatatgtcaacgccgacaaaaccgccgtcaaagcccggaatcctgaagtgaaaaagcactaccgcgagaacggcaagcgcccgtaaagcattgatattcttcctgaattgcatttatgcatccatgacacgtccactgtgatggcgcattgtaatgatcctgtcggctttgttacatggaaattatccggcgctgctcagatgttccagcgtggcgccgttagcgccaggcgctggcgcatctcgccgatgttggcggcgagttgccgggtcaacaggcgatagccatccagcgtgctgtagaccggtgcatcaaggctggcgtcgggcaactccagcgggcgctccagccgttgtgatgcaccggtcttcaaggcccgcgccatgccgatcaattgcacacgaatctgtcggtgttcagacttcaacgcggttcgcagatgggccatggcctgttggtcgttggtgtctggccgggtattgccgaggatctccagcgtgctgatgcacatgcgcaggttgcgctggatggcatcgagctcggtcatggaaatcttcacttccttggacaccgatggcatcagcgaacgcagttgcaccatcacggcacccaagcggctcatcagcttcaaatgctcatcggcgctcaccgcctggccgctgatgatgcggccgtacaccgtggcgcaatcgcgcaaggcgtcggcgaggttgtagcgccacgagtacacggcgtacagcggcagagcgaaagagaaggccagagcgagggcaatgccgatcagaatgtcgacgccgcgccacaagccgtcggtgatcggattgtcgccatgcccggcaacaatgaacacggtgatcgccgagagcagggcggtataaccccctttgccaatcgcgtgataagagaaaaaaccgcagaccaccgccatcgcaaaatacgtcagccacggcatgccgagccacgcctgctgcgccaccagcaacaaaccgacgccggcgccgatcaaggtgccggtggcgcgttcggcggcttttttaccgatgttgccgtggtgctgcaaaccgccgatcaccaccagcatggtcaccgaggcccactcaccgtggggcaggttgatgccggtggtcagcaggatcgttgccagcaacccgagggcaacgcgcactgcatgaatcagccgcgcgtgccggtagcgtcgataaggatcaagcaacggacgcaggacacggcgcagcaagggcggaagtcgatgggtgctgtaagtactcagtgcgggcctctcgtgattgggcttcagatcaatggaaagggaaaatgtaattcatccatgctgccatacgcaggaggattttgcgcatcgtgccaatgtggtggaagtgctgactgtacaacgcggcctgcccgtaagcaccgcccggcattagcttgctgtactgggcgaattccggatcggtgatttcgatgatcaccggcacacgcccggccggcggcgaaccggtgtagccgatcagcgtgccggaaggctgcacctgaccttcggcaatcaccccgatgacgtttttcacccgaccggcgaacacctttccgggaatgccgtcgaacgcgacttcagcttcatcgccgacggtcaggcgcagcaggctgttctggcgcatccacgcggcgaagtattggccttcctcgggaatgaacaccattgagggacgcaacggcaacttgctcgccatcattcccggacgcagcgaaacatgggtgacgaagcctttgctcggcgcgcggacggtggtgttgtccagctcgaactgggcgttatccagttgcgcctgcagatcatcggtgcgggcgatggcagcgtccagttcgcgctgggtgccgaagttgcgccggatcagttcggtgatgcgatagcgatcacccttggcggccaccagttgcgctttgagcgacttcatgcggttttcaaacggtgtagggtcgatgcgaaacagcacatcgcctttttccagcggctcgttacccttcaccggcacgtcgatcacctggccgctgacgatgggaatcaccggcacagacacgaagtaagtgcgcgccacctcggagtagggatggttgtagttcatggtgaaaatcagggcgccgatcatcaggatgccgcccagtacggcggtgggcaccgtccatttgttcagcgggatacggaagatcttgaacactgcgacgcagaacgcggcgtaagtcaggatgagcagcagatccatggcgttcagccctcccggttttggggggcggtggcattcagcgcttcgagtcgttcgaggcgtccttgcagttcgaccacctgttgctccaggcgaaccacatggttttgcacggatttaccgtcaccgaagccccaaccgcgatcttctcgataggccatcgcccagatccacaggaaaggccagagcgcatgcagcgtgaacagactgacccagccagtggcatggatcgcatcctgatgcgggtgtttacgatgaacggcaatttcatagggaatgtcgtgcaacacgatgatcccgtaaaacagtacgagcccggcaaacaccaaaacccctagcgcaaagtaatccagcatggtcaagctcccggcatccagcacagtgctggcatcagtgtagacactgatttgccgggcgcttggcgactttggatcagaaccgcacgggctcgccttcttgcttattcacgattcgggagaccgtggatcagaagatgtaatcggtggtcaggaagctcgaatcacgcccgcgaatgatctcgctgatcaggtccttgttgctgtcctggaacttggttgccaccagcgtgcggatcgagaacacccgcaacgcatcgtgcaccgagagcgtaccttctgccgagttcttgcggccgttgaacgggtaagtgtccggcccgcgctggcattgcgcgttgaggttgatccgcccgacctgattggcaaaggtgtcgaccagacgaccgaccgccaccgggttggtgccgaagatgctcaactgctggccgaaatccgactccagcacatagtcgatcacggtatcgagatgacggtacggcacgatcggcacgaccgggccgaactgttcttcctgatacacacgcatctgcggattcaccgggtacagcaccgccggatagaagaacgactcgcgggattcaccaccattggggttgaccacttcggcgcctttgctgcgcgcatcggccaccagaccgtgcaggtaatcgaccttgcctgattccggcagcggcgtcagcgacacaccactgtcccacggcatgcccggtttcagagtggccagcttcgcgttgaatttttcgatgaaactgtcgacgacatcttcatggacgaagaggattttcagcgcggtgcagcgctggccgttgaacgacagcgaaccggtcacggcctcgctgacggcattgtccagatcgacttccggcaagacgatgccggggtttttcgcgtccagacccagcgcagcacgcaagcggtgcggtttcgggtggagtttcttcagatcgctggcagccttgttggtgccgatgaaggcgaagatgtcgatcttgccgctggccatcagcgcgctgacggtttcgcggccgctgccgtagatcacgttgatcacaccggtcgggaagctgtcgcggaacgcttccagtagcggacggatcagcagcacgccgagcttggccggtttgaacactacggtgttgcccataatcagcgccggaatcagcgtggtgaaggtttcgttcagcggatagttataggggcccatgcacaaagcgacgccgaggggcacgcgacggatctggccgagggtgtcctgttccagctcgaaacggctggagcggcggtcgagttccttgagtgcattgatggtgtcgacgatgtaatcgcaggtgcggtcgaactctttttccgaatccttgaggttcttgccgatttcccacatcagcaacttcaccaccgcatcgcgctgctggcgcatgcggccgaggaaggcttcgacgtgctggatacgttcggccacgcgcatggtcggccacaggccttggccccggtcgtaggcacgcacggcggcgtcgagcgcggtgagggcggtgttggcatcgagcagtggcgtgctgccgagaatcacttgttcgtcgccgttgtcacctttcagatagaccgggctgcgcacggtggcgagcgggccgtcccagcggcgcaactggccgtcgacgagatattcgcgttgctcgacctgaccgtcgaggcggtatttttccgggatgtcgctgacagaagggaacagattgccaaggatgtttgctgtggtcatgtcgctaccccgtgttgatgtccgtatgcagatcaaaaagccttcacaggttatacgcctgaatgcgccgcaatttaaacccgcaaatgtcacccgaatgtcacgcaaacgcgcagagcagagcgggcagcaacaccgcaaactctgtgggagctggcttgccagcgattgatcgttcccacgctccgcgtgggaatgcagcccgggacgctctgcgtcccattggaacgcggagcgtcccttgaggcattcccacgcagagcgtgggaacgatcaaggtaaattctgcctggcctcgtttgcccccctcgctgtcccgcaatgccctcaacccgttgcagccgctgccttaaggtgtgagcacaacaataagcgaggccgttatgccggcaatccgactcactctaatgctggcgttggccgtggcgctgcctggctgcggcgaagatcccaaaccaccggtcaccacccataacgccatgcccaacgacccggcactggcgcagatctacaccaacagctgccagctctgccacgccaaccccgctgccaacgcgccgctgaccggcgaccgcaaggcctgggaaccgcgcatccagcagggcaccgacacgctgctcgaccacgccatcaacggctacaacggcatgccgccgatgggccagtgcgtcgaatgctcgcaagaacagtttgtgcaattgatcggcttcatggccgaccagcccctcccagagtaaggtgcccggcatgaccatggatctgacacggcgtcagttgttgcaacgggcaagcattgtcggcgcgttcagcgcgttggcgagccatccggcattgggccaattgatgcgcgcaccaaggttgattccgtggcgcaactggtcgggtgggcagagctgcctgccagcagcgcggctggcaccgaaaaatctcgatgagctggtgaccgctatccagcaggcgcagggcaagatccgcccggtcggctcggcgcattccttcagtgcgttggtgcccaccgatggcacgctgttgtcgctgagctatttcaacggtttgctcaatcacgatgggaaaaccttgcaagccgaattcgccgccggcacaccgatgtcacgcatgggcctgccgctgaaagacatcggccaggccctgcaaaacatggctgacatcgattaccagaccctcgccggagccattgccacgtcgacccacggcaccgggaaaaacttccagtcctactcggcccacgtctgcggcctgcaactggtcaccgccaatggcgaagtgttggactgcgacagtcagcgtcaccctgaagtattcaatgccgcacgggtttccctcggtgccctcggcgtggcgacgaaaatccgcctgcaaaaccgcccggcctatcgcctgcgcgaacgccagtggatcgccaagaccgaagaactgctcgaagacctcgacaggaacacccgagagaaccagcactgggaaatgctcgtcgtcacccattccgactacgccttgtccatcgccctcaacgaaaccgccgaaccggcgacgccgccgattccgcctgaagaggagggcggcaacgagtttgtcaccctgatcgagaagatcgacaagtacggcagcgacttccccgacctgcgccgcacgctgctcaacagcttgcgccatctggccagtttcgatgatcgcatcggcgactcgttcgacatttacgccaacgtgcgcaccgtgcgtttcaacgagatggaatattcggtgcccgccgaacacgggccggcctgcctgcgcgagattctcaagctgatccaggacaaggacctgcgcacctggtttcccatcgagtaccgctacgtcaaggctgacgatatcccgctgagcatgttcgagggccgcgacagctgttcgatctcggtgcaccagcattatcagatggaccatcacaatttcttcgcagcggtcgagccgattttctggaagtacaacggccgcccgcactggggcaagttgcacacgctcaacgcgcaaaccctgcagccgctgtatccgcgctggcgtgagtttgtcgatgtgcgacaggcgctcgatccgaacgggcgctttctcaatgcgcatttgtcgtcgattttggggatgagcttatgacggtcaatcgacgtaatttcctgttgggtacgttgggcgtcggcgctttgttggtgggcgttggcgcttggctgcggccgggggatcgtggcgcgccgtacagcgaatacttccgggcgctgaacaacgagttaaaggaaaaggggccgatgcgtccggtgctgctgattgatctggatcgcctcgaccacaacatcgatgtggtgatgcagtcggtcaaacgcggtggcaagcaattgcgtttggtggagaagtcgctgccatcgccggggctgttgagctacatcgcccaacgtgccgggacgcaaaaattgatgtcgttccatcagccgtttctcaatcacgatgcgcaggtgtttccgcagtccgacattctgcttggcaaacctttgccggtgcgttcggcagcgcagttttatcaatcccacaaaggcgcgttcgatcccgcgaagcaactgcaatggctgctcgacgggccgcagcgtttgcagcaatacctcgcgctggctcaggggttaggcacaaggatgcgcatcaacatcgaactggacgtcggcctgcatcgcggcggcgtcagtgatgtgaatgtgttgggccaaatgctcacgctgatcagcgccaacccgcagcatctggagttcgccgggttcatgggctacgacccgttcgtgggcatgggcgtgccggggatccttggcgcaccggaagaactgttcgccaaggtcatggtgatttatcagcgctgcgtggatttcacccgacagcagttcccggcgttgtggcatgacggcttgtgcctgaataccgctggcagtccgagttatcgcattcatgaaaacgagaaactgagtaccgaggtttccgtgggcacggcgatgctcaaaccgacgcactatgatttgccatcgctgaccgagcatgtgcctgcgacctatatcgccacgcccgtgttgaaaagcactggcgcggtgaatatcccggcgctggatgacaagtcgaagctgttttcgtggtgggaccagaaccagcgccagactttcttcatctatggcggcaactggatggccgaattcgaatcgccccagggtttacagagcaacagcgtctacggacgcagctccaatcaagagatggtcaatggctcgaatgccgtcggcctcacagtggaagaccaggtgttcctgcgcccgatccagaccgaagccgtgctcctgcaattcggcgatctgctcgccgtgcgcaacggcaaaatcgtcgacacctggcccgtctacacctgacccaaaatcaccaccaatcccctgtaggagtgagcctgctcgcgatagcgtcctgtcagttgatatttatttggctgacacagcgctatcgcgagcaggctcactcctacattggatgtgtgtacacccatacgcggtaatgaagcttttatgacaaaagttcggtagcacatcgccagtccggtcatgcctatgtaacgcgcttgaggagcccaacggggcgcttttcacaagccgaggcgggacgccgggagtgaggcaatggggactatggaacgctactcgaaagtgggcatgcaggaactcgatcaacgcctgtcgaagatcgtcgaagccgcgcgcaagaagccggtttcggtgtatcgctacggcgcgccgtgggtctggatcgtctcgcaggatgactggcaaggcgccttgaaagaggtgtccagctacattccgccggggcattcgctggttctgttgcgcccgcagatcgatgatctgctcgacgcccaccaaagccttctgcacgacctcaatgcccagcccggcatgctgatccccgcgcaaacggtcatgcacattctgcttctgcaactgctgtattcggtgcccagcgagcagcaactctacgaacagctcaattacaacttgctgttccgctggttcgcaggtcttggcctgaaccagaaagtctggagtttcaacgccctcagtcgcgacatcgccacgctgctcaatgagccgcgcgcggtgctgctcattcaaaaaatcatcggcgaagtgttctgcggcgccttgctgcaaatgcccgagttctcgttgaacttcgcgcttttgcacacgtggctgggcaaacacgcctgcgcttcgacagccagcaattgacgccatacacgcggcgttcgaaacgccaacaggtcatcgcgaattcagggggtagtgtggaaccgattttcaagtcacggctggcgctgtggggctggctgctggtgacggcgggcgcgcagccggcattggccgaagaggctgccgaaaacgcggcggcccagcgtctggtcgacgtcaacgaatacttcgtgcgcggcaacactgtgctcgatgcgcgggcgattgaagaagcggtgtacccgttcctcggcccgcaaaaagccctcaccgatatcgaaggcgcacgcgatgccttgcagaaggcctatcagcaacgcggctatcagtcggtgttcgtcgagctgccggagcaagccgtcgccgatggcatcgtctatctgcaagtcagcgaaaccaaggtcggccgcgtgcgtgtggtcggcgccaaacactattcgccgctggacatccgcgacgacgtcccggcgctgaaagaaggcgaggtgccggacttcgccaaggttcagggcgaactggcgcagctcaacaaaaccccgggccggcaagtgatgccgctggtgcgcgaagggcagcgccccggcaccatggacgtcgatttacaggtcgaagatcagaacccgtggaccgccagcgtcggcctcaataacgactacagcgccgacacggaaaagctgcgcaccgtcaccagcctcggctacaacaacctctggcaactcggccatagcgtcaacctgacgttcttcaccgcgccgcaggaaaccgacaatgccaaggtctggtccggctcctacaccgcgccgctgaccgagcgctggagtgtgcagttttccggttaccagtccgacagcaacgtcgccaccatcggcggcagcaacgtgctcggcaagggccatagctacggtgtatcggcgatctacacgctgccctccagcggcaactggtcgaactcgctgtcggccggcatcgacttcaaggacttcgacgaacgcctgaccctgtccggcgagagcgacaaagtccccctgcaatacgcgccgttcaccttcgcctacaacggctatcgctacagcgaaaagagtcagctcggcctcggcctgagcctggttgccgcgacccgcagcatcttcggctacggcagctccgacgaagatttcgactacaaacgctaccgcgccaaaccgagtttcgccgtgctcaagggcgacaccaattacacctggaccttcgacagcgactggcagagcgcaagcaaagccgcgttccaactggcgtccgggcctttggtttccaacgaacagttctctgccggtggcgccacttcggtgcgcggttatctggccgccgaacgcaccggcgatgacggcgtgctgctcagccaggaagtgcgcacgccatcgctggccaagtacgccggcacatggatgcaggactggcgcttctacgccttcgccgaaggcgcgcaactgtatctgcgcgacgagctgccggatcaggacgccaattacgccttggccagcgtcggcctcggcacccgcgccagcctgagcaaatggctgtccggcagcctcgactggggctacccgctactcgaagggccgaacacctcgaaacaggaatcgcgcctgcacttcaaccttcaagccactttctaaaggagcacgttcatgcagcgcctcattctttcgttgttgatctgcctgggcttcgtgctcccggccacggctcaggcctggtggcaggacgactggcactaccgcaaacagatcgccgtcgacaccacgccgcaaggcgcggcgatcaatcaggcccttggccgcaccgcgctgctggtgcgtctgcacaccggcaacttcaccttcgatggcgtgaaggaggacggttcggacctgcgctttgttgccgccgatgacaaaaccgtgctcaaccatcagatcgagagtttcgacgcgttgatgggcatggcgctgatctgggtcgatgtgccgaatgtcgagggcgggcagcgccaggacatctggatgtactacggcaatcagaaggccccggcgactggcaacggccaactgactttcgacccgaattacaccgcgctttatcacttcgacggcgccaccggcgccccggccaaagacaccaccgcctatggcaacacggcgcaaagtgcgaccggcgcggcgattgacggtgtagtagggcgcgcgttgcagttcagcggccagccgttgttgctgccggccagcccttcgttgcaacacaacgccggcagtgcgttcaccttcagtgcttggctgcgtctggatcaggccagtggcgaacaactaattctcgctcgccgtgagggcaccaacagtctgctgatcggtgccaatcaaggtgtgccgtttgtagagatcgacggccaacgtgtcgtcgcctcccaagcgctgaatccgggccaatggcaacacgtcgcactgaccgctgaaggctcgaaagtaaccctgttcatcaacggtcgcgaagctgccacgctcgcgcaggcgatgccggccttcaactcggtcatggccatcggcgccgacctgcacgaaggcccgttccagccttttgtgggcgctatcgatgaattgcgcctgtcgaaggtttcacgcccggcagcgctgttgctggcggacgcgacttcccaaggcgccgagtcgaaactggtcgcttacggcgtcgacgaagaacagtccggttttggcttcggcagcctcggcttcctgctcaacgccgtgccaatcgacgcctgggtgatcatcgccgtgctggtgctgatgatgttccagtcgtggatcatcatgctgcgcaagaaccgcagcctcagccgcgtgtctgccgccaacgaggacttccgcgtgcagttcgccaaggtcggcacacgtctggagatgttcgccgacgacgcgcaactcgcccagcgcttgcagcattcgtcgctgtggcgtctgtacttggtggcggtcaaagagattcgcacccgtcgcgagcagggcgccgatacctcctcggtgtcagcggcgaccatcgaagcgatccgttgctccatggacggcgtgcgcacccgcgaaaaccagcagctcagctcgaagctttcgaccctgtccaacgccatcgccggcggcccttacatcggcctgctcggcaccgtgctggggatcatggtggtgttcctcggcacggcgatggccggtgacgtgaatatcaacgccatcgcgccgggtatggctgctgcgttgctggccacggcaatgggcctgttcgtcgcgattccagcgctgtttggctacaaccgcctgatcacccgcaacaaggaagtcagcgccgacatgcgcgtgttcgtcgacgagttcatcacccggctggcggagatgcatggcgagagccagttcagtgaggcgtcgcatcgcggccatcacgccaaccactccgtaccggcctgaggagcactgacatggcgtctgtaaatgcctcccacgacgatgacgaagatgcagcggtggacagcatcaacatcaccccgctggtcgacgtgctgatggtggtgctggtgatgttcatcctcaccgccaccgcgcaggtctcggggatccagatcaatttgcccaaggccagcgcttccgtgtcgctgtccgaggccaagaccaaggcaatttcggtcaacgatggcgggcaggtgttccttgacgcttacccggtgaccttggccgagctcgaagaacgcctgcgcatcgagaaggcgcagagcccggatttcccggtgatcgtgcgcggcgacgcgacggtgcaataccagaaagtcatcgaagtgctggatctgttgcgccggctcgaactgtcccaggtcggtctcgtcaccggcaaaccgagtcagggctgagtcatgaccgcacaactcccgatcgagccgctgccggtgaaaaaaccggcgctgcgttacgccaagtggggcgccggattgctgatcggcgcgctcgccgcgtggttcctctggcaatgggccaacgacatgagcggcatccgccgcgaagcgccgaaggtgccgacgatcattccgttgccaccaccgccacctccgccgccggaaaaaccgccggagccggaaaccccggtggaagaaaaagtcgtcgagccggagccaacgccggagccggaagaggtcaagcccgaggaagaagcgccgccatccccagcggacgatctggccaacccgatgcaaatggacggtgacgctcaaagcggcaacgacgccttcaacatcggcgcgggcaagggtggcggcatggccggtgcgggtggcggacgtttgggcacggggacgtacagccagtttctggcgttcaccttccagcgtttgctgcgtgagaaccctgagctgcgcaacctcgcgttctcgctgcaggccgatgtctggttgagcggcgtcggcgaaatcacccgggtcgagctgatcaagtccagcggcaaccccgaaatcgatacccaagtgttggcggcgctgcgcggtgccccggcgctcagcgaacggccaccggcctccatcactttgcctgtgcgcctgtccctgcaagggcggcgtccgggttaattcaacctatttattgccaagcattaaagctttgccaaaaggagttgtgtgcagatgatttccaacgtgaatcgattgtccctggcggtcggcatggtcattgcgaccctggtcggtcaggccgcggcagcgcctgcgccctcggagaacgccacgatcaatctgatccgcttgctggtcgagcagggcattctgaaacaggacaaggccgacgcactgatcgctcaggcgcagaacgaagcggcgcaggctaaacaggctgcggcatccaccgctgtggcggcggggccagtggcggcgccgggcgacgtgcgtgtgcaatatgtgccggccgcggtgcgcgaccagatacgcgatcaggtcaaagccgaagtcatggccactgccaaacaggaaaactgggccgcgcccaacagcttcccggaatgggctgcgcgcatcagtttcgacggcgacattcgcttgcgcaacgaatcgcgctactactcggacagcaacagcaacgagatcgtcgacttcgccaagctcaacaacaacggcccgtacgatgtgaatcccaacagcagcaccagcctgccgccgctgctcaacacccgcgaagaccgcaccaaccagttccgcatccgcgcacggttgggcatgaaagccgagatctcgccgcaatggaccgccggcattcgtatcggcaccggttcggacaacaacccggtgtcgaccacgcaaaacctcggcggcggtttcgccaaaaaggacatctggctcgatcagggctacctcaactggaagccgacggatgagctgaccctgaccggcgggcgcttcgccaatccgttcatgtccaccgacatgctctattccaacgacttgaatttcgacggtgtcgcggcgattttcgaccacaagctcaaccgcgattggggggtgttcggcaccgtcggcgcgttcccggtggattacaccaacgacaccgccagcagcaacggcttcgacaaggaagagagcgacaacaagtggctgtacggcgcgcaagtcggcgccaaatgggcgatcaacagtaacaaccgcttgaagggcgcgttggcgtactaccgtttcgacgacattcagggcgagcgctccagcccttgcgagccgtgggccggtgcgccgggctgcgacagcgacggcagccgcacggcgttcatgcagaagggcaacagcgtgttcctgctgcgtgacatcacgccgaacccgctcaacccgagcaccacgccgcagccgcagtttgttggcctcgcttccgaattcaatctgctggacttgaacgtggtgtgggacgccgacctgccagaagatttcaaactgcgcagccagggcaactacatccacaacctcgcgtacgacgaaggcgacatgcgcaagcgttccgccgggcagatcgtcaacaacctcgacagcaacggcaacatcgaaagcggcgccaatgcgtggatggtgcagttcaccctcggcagcgcgctggacctgaaaaagcagggcgactggaatctgttcgctggctacaagtacatccagccggatgccttgccagatggcttcaacgactcctcgttccacctcggcggcaccaacgccaagggttatttcatgggtggcaactacggtctggcgaagaacgtttatgccaccggtcgctggatgagcaccgaagcggtgtacggcgcgccgttcgacatcgacgtcttgcagcttgagatcaacacgcgcttctaaggcgccgggagagggtgatgaaaatccgctttttatggtttgggctcggcatgttggtggccaccggggcaagcgccgaaggcatggaagaacgcctgcgcacgcaattgcgcagcaccgctcagcaactgcagaccctgcaaagtcagcaggcccaggccagcgccgcgcaactggcggcgcaaaacgaagccaaggctgcgcaggcgcaaatcaagcaattgagcgctgagctggccaaggccaaaggcgttgccgagcaattggccggacagcaacagagcctgcacagccaggcgcaggcacaagtggcagccagcgccgagcagaccggcaagttcaaaaaggcctatgacgagttgctcgtcatggcccgtgccaaagaggcagaacggtctaagcttcaagcgcaattgactgaacgtgacacacaagtgcagcaatgttcagtcaagaatcagcagatgtacggcgtcgccaaacagatcctcactgcctacgaaaacatcgacgtggccgaggtgatgaagatccgccagcccttcgcgggcagcgcccgggtcaagttcgatgaactggctcaggggttcggtgacgagctctacaagactcaattcgacgcgccgcaagccgcgctcgcgcattgatttaaaagactgctaaacaaggaagaaacaatgactcaattgatcagccacgtatcgccacaatccctgaccgacgtcctgcaagcggccggttatcgcgtcaatcagaccgaacagaacggcatcgtccagttgctcagcgccagccagggcattggttacgccgtgcgtttcggcaacccggcggtggagcagggcagctacgtcgatttcacgttcagctgtgcgctgcgggtgcagggtgagttgccgcagggtgtggccgagcagtggaacgccacgcgccgttttgcgcgcttgtcgttgcagggcgagtttctggtgatggaaatggacgtggtggtggcggcgggcgtgagcaacgatcacctgcgtggcaacctggaattgtgggatcgtctgctgcaggagttcatcgtttatctgcgtgacttcacccagaacggcagcgcgcagaccgccaaagtcgccgtggccgaggaagaggaagtcgcgctgtgaaaaagcctgccatggtgatcagcgccgctgcggtagcgctgttggtggtggccgtggcgctggtggtgcgaccgggcagtgacccggtcgccgcccagcaatcgtcgccagtggcggcggttgctgcggggccggcggtggcgcggttgggtaatcagcaggtaacccctgcggaacttcagaccctgctcgcgacagtcccgccagagacccgcgaacaattgcgcggcaatcgtgaggcgctggagcgctggattcgcacgcgtctcgccgagaaagcggtgctggagcaagctgatgcgcagggttgggcgcagcgcccggaggttgcgcggcagactcgtgcggcgactgagcagattgtctttcgcgattacttgcgttcggtcagtgaagtcccggcggattatccgagtgctgccgagttgcagcaggcctacgatgccggcaaggcgaactggcagactccggcgctgtatcgggtcagtcagattttccttggggtgaatgatccgcagaatcttgaatcggtgcgcaagcaggcgctcgaactgagcaagaaagcccaggcgacgccggcagaatttgctgcgctggcgactcaatattcgcaggatcgcgtcaccgctgaacgcggcggcgatagtggcctgcaaccgttgcagcaactcgttccggaggtgcgtggcgctgtggcgcggctcaaggttggcgcagtctccgatcctgtgcaaagcgccgccggtttccatgtgatcaagctcgccgagcaacaacccgcccgtaccgcgaccctcgacgaactgcgcgatcaactgacccaggccttgcgtgcgcagcgtcaggagcaaatcgcccaagcctatctggacggaatgctcaacaccgcaacactgagcatcgacggcgctgaactcaacaaagtcctagaggaaaaacgctaatcccaccgtcaccacaagccccctgtaggagtgagcctgctcgcgatagcggtgtgtcaggttaagcaatgtcgactgacacaccgctatcgcgagcaggctcactcctacaaggaattgcgtaaaggcaaccacaaagatcgacagggagtcatcgatgtcattcaccgaacccgcaggacgacagggcagcgccgagtactgctgggcgcaggacaaaagcgattcctggctggcacaagccgccgcgatcaatgccgatatcgcccaatatttcctggtcagcgcccgctgcggctgcttcatgcaagccgcgcgcagcctcaacgtacgctcgaccttgctgcgcaaacagttggcgcagcttgaacaagaactccagcactcactgttcagctttcagggcagcgccctgagcctgacccgcgaaggccaacagctacaggccaagctggtcgcgctggcgaatgaacgcaaactcccggtgatcgagcaaccgctgattcgcctggctgtcgccgaatcgatcctgcatgacatcctcggccgcgacctgatcgcgctgctgcgccgcaacgccagtgtgcgcctggaaatcatcgcgctcgacagcgaattgtcgctgcgcgcggtcagcgccgacatcgtcctctggctcgcccacggcgaaaccccacaccccggcccgaccttcgccaccagcgaaccgcaagcgctggcgcgcctcgactacctgccgcacatcgccaaacgctactcccgcgttaccgcgcgcccggacacccccgacgacctcgccgacttcatgctggtgcaatggcaacacgaccggcagatccatagctttcgcccatggaatgagctggtcgaacagcggttggccggggtggtgcagatgcagtcctatgaactgatgctggagatgatccgttgcagcgcgtgcattggtttgctgccggcgtatatgagccgctttgatcgaggcctgattgcgctaccggggctgttcgagggaccgatgcaattgcaggcgtggctggcggtcaacgctgaatcgcagagcatgcccgaagtgcagaccctcaccgacctcatccaccacactttcaacgaacgccaggaatggttccagccctgacgcattcccctgtaggagtgagcctgctcgcgatagcggtgtgtcagattgatcaatgttgactgacacaccgctatcgcgagcaggctcactcctacaagtatttacctatggcagatgtcgtgtttggcggtttagagtggtcagccacacatcgatccaggaaggatccgccatgcccgaccacaacgccgccattcacatcgaacgcttcagcgagtcgcacctcgaggctgtcactgcgctctacaacgagcgggccgtcacccggcaggtgttgcagatgccgtttcagtccgtcgacgtctggcgccaacggctgctggcggaaaatgaacgggtgttgaagctggtcgcgttgcatcagggcgtggtgatcggccatttggggctggaaaactattcgcggattcgccgcagccatgccggcagcgtcggtatggcagtcgccggggcgtggcagggcaaaggcgtgggttcgaagctgttggcggcggcactcgacgtcgccgacaactggatgaacctgcaccgcgtcgaactctcggtttacgccgacaacgaggccgccatcgcgctctaccgcaaattcggtttcgaggatgaaggcctgtttcgcgattacgcggtgcgcgacggacagtgggtcgacaccctgagcatggcccgcctgcgcaatcgttcgaaaacctgacttactcgcccagcgcgaacgccaccgccgactgcgcatgcagctcggtggtgtcgagcaggggcagggcgctgtgttcgggtttgagcaacaggccaatttccgtgcaaccgagaatgatcgcctgcgcgccacgagcggtgagggattcgatcacccgctgatagatttgccgcgactgatcgctgatcacgccgacgcagagttcgtcgtagatgattcggtgcacgtccttgcgctcggcttcgtccggcaccaatacggtcaaacccttggcgaccaggcgttgcttgagaaagtcctgttccatcgtgaatgcggtgccgagcaaaccgacggtgcgcgcatcaatgtccagggcagcctgcgcggccggttcggcaatgtgcaggaacggaatgctgatcgccgcctgaatctgctcggcgaccttgtgcatggtgttggtacacagcaccacacattccgcgcctcccgcttccagcctgcgcgcagcatcgaccagaatcgccgccgcatcgtcccagcgcccggcgtgctgggcctgttcgacagggccgaagtcgacgctgtacatcagcaattgtgccgaacgcaacgggccgagacgatcacggacgtgttgattgatgagtcgatagtattcggcgctggattcccagctcatgccgccgatcaggccgatggtgcgcattggatgtcctcaggcaaatgacagtgtcgagtattcaggtctgccagaagtttccttcggtttccggcacgataccagcagcaactgactgtaccgctgatctttcacgcaagtgtcatggtgtttctgaccgtacagagaggctccgatctgccactatggtgtttcgcaggatcctttccgaggcacaccgcaatgagcgacgttcaacaactgggcgagatgcttcgtcactatgccgaaagcgaagcgcacaagaagcaggttttcgaaacgcagtcgcaagtctgggcaacacggatcaccgggttgttcggcgatattcagcaatggctggagccggtgcaagcgccgaatctgctggaagtcagccgcgaaccgtatgtcgcattcgggccgagcacgccggtggagacctcgaccttcaagaccgaaaaactgagcatcgtcatcgctggaaaaccggtagagtttgtgccagacgtaatgggcagcgcgggacagatttccctggcggtgatggggctgacggcggcgcggtatggcagcatttcgctggtcggattgccggacggcacgtggcagtggcgcaagaccaatggcctgaaggacccggataccttcgccttcgatgccaacttccttgcccagcaactgcaaagtctgatcccccgcgatcgcgcctagatcacacggactctcgcgatgatcgtccccacgctctgcgtgggaacgcctctacggacgctccgcgttcggcttttgggacgcagagcgtcccgggctgcattcccacgcagagcgtgggaacgatcaaggcgagaaggctacatatcgagattgacccaccccggcttcgccacctccggcgccaccgctttcacggttttaccggtggccagctccacccgccgcgccacttccggatcgtcggcaaacggcaccatgctcgcctcatccagactgtccgccgtctcccgccgcaagcagtactcgaccgccagccacagaaacaccacgcccagcacatcgaaaaaaatctccagcatgaccggctccccgcctcaggcgatctgcgcttcacggtgggccagtgcgacgtcggcgacccgcaccgtgcgccagacgttgtaggccatcagcaacatcccggtgaggaaaaacacccccccggcgaagcgcacgatgaaccccggatgactggcctgcagcgcttcgacaaatgaataagtcagcgtgccgtcctcgttgatcgcccgccacatcaggccctgggtgataccgttgacccacatcgaggcgatgtacaacacggtgccaatggtcgccagccagaagtgcaggttgatcagcggcgtgctgtacatctgctcgcggccaaacacttttggcaccatgtgataggtcgcgccaaaggtgatcatcgccacccaccccagtgccccggcgtgtacatggccgatggtccagtcggtgtagtgggagagggcgttgacggttttgatcgccatcatcggcccctcaaatgtcgacatgccgtagaacgccagcgacaacaccagaaagcgcaaaatcgggtcggtgcgcaacttatgccaggcgccggacaaggtcatcatgccgttgatcatgccgccccagctcggcgcgagcaggatcagcgacatggccatgcccagtgactgcgcccagtccggcagcgcggtgtagtgcaaatggtgcgggccggcccaaatgtacagggtgatcagcgcccagaaatgcacgatcgacaagcgatacgaatacaccggccgattgacctgtttcggcacgaagtaatacatcatcccgaggaacccggtggtcaggaagaaacccaccgcgttatgcccataccaccactgcaccatggcgtcggtggcgccggaatacaccggataagacttgaaccagtccaccggaatcgacaggtgattgaccacgtgcaacatggcgatcaccagaatgaacgcgccaaaaaaccagttgccgacgtagatgtgtttggtcttgcgttgcaccacggtggtgaagaacaccacggcgtaggcgacccagaccacggccatccacaccgcgccggagaattcgatttcggcgtattccttggtggtggtgtagcccatcggcagagtgatcagcatgatcacgatcactgactgccagccccagaaagtgaatgcggcgagggcgtccgagtacagccgcacctgacaggtgcgttgcaccgcgtagtaactggcggcaaattgcgcgctgccggcgaagccgaaaatcaccaggctggtgtgcagcgggcgcaagcggccgaaagtggtccacggcaggtccaggttcatctctggccagaccagttgcgaggcgatcaacacgcccatcgccatgcccaccacaccccagaagatcgtcgcaatgacgaattggcggacgaccttgtagttataagcctgtccgattgttgctgtgctcatggtcagttcatccacggttgcaaagtcttgccaggccacccggtctggcatgagctgcactgtagaaaccccgtcagaaacaaaacaggctcaggaattgttcatttgtgcggatcagatggaagtactggctgcggcgttctgccgcgccctgatatggtttttatcgcttcaggtgaatctgtaacgcgctgcgctgcttcgtcatagtgctttgaagaaaactgtgggagcgagcctgctcgcgaatgcggtgtgtcagccaacaatgcagttgcctgacacaccgcattcgcgagcaggctcgctcccacaggaataactgatgaggtggcacgcatgtatcaatacgatgattacgaccgggcgctggtgttcgagcgcgttgcgcaattccgcgatcaggtcgagcgcttcatggccggggaattgagcgaagaggagtttttgccgctgcgcctgcaaaacggcctgtacctgcaaaaacatgcctacatgctgcgcgtagcgattccctacggcaccttgagcgccgagcagatgcgcacgctggccagcatcgccagtgactacgatcgtggttacggccacttcaccacgcggcagaacatgcagttcaactggatcgagctggccgaggtgccggacatcctcgaacgcttggcgcaagtgaacatgcatgcgatccagacatcgggcaactgcgtgcgcaacatcaccaccgaagcgttcgccggagtcgccgcagacgaaatgatcgacccgcgcccgctggccgagatcctgcggcagtggtcgacgatcaacccggaattcctcttcctgccacgcaaattcaagatcgccatctgctcggcgaagcaggatcgcgcggcaatcatgatgcacgacatcggcctctacctttaccccggccgcgacgggcagatgttgctgcgagtgatcgtcggcggtggcctggggcgcacaccgattctcggtttgcagattcgcgaaggcttgccatggcagcatttgctgtcctacgtcgaagcggttttgcgcgtgtacaaccgtcacggccggcgcgacaacaagtacaaggcgcgcatcaagattctggtcaaggcgttgggcatcgaggcgtttgccaaggaagtcgaggaggaatggcagcacctcaaggacggcccggcgcagttgaccgaagccgaatatcaacgggtcgccagtgccttcgtgccgccggtttatcagaccttggccgacaccgatctggacttcggcacgcgtctggcgcaaagcccggcgttcgcccgttgggtcgcgcgcaacgtgcagccgcacaaggtctcgggttacaccagcgtggtgttgtcgaccaaaccgggcccgacgtcgccgccaggggatgtcaccggtgtacagatgctggcggtggccgactggtcgcagcgtttcggtttcggcgagatccgtatcgcccatgagcagaacatcgtcctgcccgacgtggcgaagagcgacctctacgcgttgtggcaactggcgtgcaaacacgatctgggcagcgccaacgtcggcctgctcaccgacatcattgcctgccccggtggcgatttctgcgcgttggccaatgccaagtcgatcccgattgcccaggcaattcaggcgcgcttcgataacctcgatttcctgcatgatctgggcgatatcagcctgaacatctccggctgcatgaacgcctgcggccatcaccacattggcaatatcggcattcttggcgtcgataagaacggcagcgagtggtatcagatcaccctaggcggcgcccagggcaaacacagcgcgctgggcaaagtcatcggcccgtcgttcagcgctgccgaagtgccgcaggtgatcgagcggattatcggcacgtttgtgcgctatcgcgagcatgaggaattgtttatcgacaccgtggcgcgaataggcctggagccgttcaaggaacgggtctatccgaagacgctggaggccgcggtatgaataatctgttgcggctggagcagggcgtggcgcgaatagtgacgaacgatccgtggacgctggtgcgtgagccttcgacgccacggccttcggggttgttgatgctgtcgctggcgcactggctgcaatcgccgtcgtcccacgcggtgtggctcggccccgacgatgaggtcgaaagcctgctgccgtggctggcctcgttgccactgattgcgctggatttcccgagctttcgcgatgggcgtgcttacagtcaggcgtatctgctgcgcagccggtttggttggacaggggagttgcgcgcgattggcgatgtgctgcgtgatcagctcagccatatgcgccagtgcgggttcgacagttttgcggtgcgtgaggacaaatccgccgaggatgcgctgaaaggattggccgggatgagcgtgctgtacgggcgctcggtgatcgagccgcgtccgcttttccgtcggcgttgacggttaaaaagatcgcagccttcggcagctcctacagtggatcgcgtgtaggagctgccgcagttcgggccgcgttcggacgatcttttgatcttcgatgtacaccggggaaacccctagaacctgatgaatcgggcatttttccttgggtcgatggtggccttttggtagagtcgccgtcgccagcgggttttcggctggacgatggaaccgaagaagggagtctgatcagtgagtccgggcaaaaaaattctcggccttacagcgttgcttttgatggtgacgctgtgggccagttacttttacgtattcaaggaaaaccgcagcggccagctcggcggcgtcggtgaaagcaccgcgtggtgcggcacgccgccatccacggaagcagcgttgctgggcaaggaccaactgaccttgcgcgtcaccaacaacctgcgcggcgagttcatgctcggcggctccctggtggtctccgaacgtaccttcaaccgctatgacctcggtcgcaacgaactgcgtttgcgtctggaacccttgcagtggacctacggcgccacgccgatcttcctcgaacaggtgaagatccagccactgagtcgcaacctctctacgaccaacaaaagcgcctacgcgcaactcgaatcacgtccgatcggcgtgcagggccaggtcaccgaattcccgttcgacacgtatcgctacggctacaaaccggtgctttattacctcaagggcagcgagcgcattgatctgcgtttcaagaacatcaccacgctgatggagatgtccaacaccttcacgccgatccagaagtacaaccgcgtcgactacatcaacgagaaaacctcgatgatccgcgatgaggattacaaggcctacgggccccacgaatgtgccttcagcgtcgagcgcaaaggttcgttcaaggttgtcgtgttgttgctgctgttggtgttgtgcctgccgttgctgcttgtgttctaccgcaatgaaccggggatcgactttctcgccacgctgttgggcgctgcgatcgtgcgggtgctgctgatcgggccggtgcaggatttccagctgtacaacatcgacttcctgttgggggcggcgattttgctggtgggcacggtgtcgctgatcaaggcgatgcacatcaacagccggcgggagatggcgttgcgtagcggtgagacttcgtcctggtaatcgggtgagtccttaaaagcccctcaccctaaccctctcccggagggagaggggacagaccgagttgtctgtcgtcctgcaccgacgtgaaagaccgagtcgactatcgattcaaagccaatccttcacgtcggtgtatctcttgaatatcccccaatcggtcccctctaccttgggagagggctagggtgagggggcgacaatctccagccaatcacttgagcgccggatcacccatattcatcttcttccacccctgcaacagcacccgcgccttttcctggtaaacggttgaaccttgaaaagcccctcaccctaaccctctcccggagggagaggggactgaccgaggtgtctgtcgtcctgcaccgacgtgaaagaccgagtcgactatcgattcaaagccaatccttcacgtcggtgtatctcttgaatatcccccaatcggtcccctctaccttgggagagggctagggtgagggggcgacaatctccagccaatcacttgagcgccggatcacccatattcatcttcttccacccctgcaacagcacccgcgccttttcctggtaaacggttgaaccttgaaaagcccctcaccctaaccctctcccggagggagaggggactgaccgaggtgtctgtcgtcctgcaccgacgtgaaagaccgagtcgactatcgattcaaagccaatccttcacgtcggtgtatctcttgaatatcccccaatcggtcccctctaccttgggagagggctagggtgagggggcgacaatctccagccaatcacttgagcgccggatcccccatgttcatcttcttccacccctgcaacaacacctgcgccttcggctcctgcccactgtcgagataccactgaatcagcgacaaccgcgcattgcggttcgccggttgcaccttgagcagcccctccaacaccgaacacgcctcatcgaccttgccactctcatgcaacgccaccgccagcacataaccgtactgagcgttctgcggctccagttgcgcagctttcttcagcggtgccatggcttcggcagttttgcccgcgcggatcagcgacagaccttgagtgtgctgcaacagcgccgcgtccgggtgttgcttgaggctgtcatccaacagcgtctgcgcttcctgaccacgaccattggcttccagccattgcaccagcgtcaccagtgcaggatagaaatccgggtcgcgcttgagtgccgagcgcagcagaccttcaacttccgcgccgcggccactggcctggtacagcatcgccaggttcagattggcctcggcacgttcgagcagactcttctgcaccgcttcgtattcggcaattgcggcatcccagttggcttgcgcagaaccgagaccgccattgcgcgcaacactgagcagatcccgtgcggcaacgatgcgtacggctttcaccggatcacccagcaacggcgccaacaacggcgcacgctccggaggcggcaagaacgcgctgattgcccgcacggcgctttcgcgtacctgcggtgcctgatttttcaggtcctgtgtcgccagcttcaacgcttgctcactcggatacagcggcagctccgcgagcaatgtcgcccgttgaatcgccggcagattactgcgctgcaactgctcataaagtgcatcagcggcgcccggtcgcccattgcggatcagccacaggctttcgtcgtagcgcggtgcttgcggcgcggtggaggcgctccacagcttgaattgtgcggtgaccttgtcgccggccttgccttgatggcaggtcagacaggcatccggcgtgccgagcttctgcgcgcgttccgggtcgggaatgctgaagctgtggtcatgtctgaagtcgttgcccatatagaacttgccaggcatgtggcaatcgacgcactgcgaaccgggctgacccatggtgtgacgggtgtgttcaatggaatcgtagttcttcgcctgcaggcccttgccgtccacaccctcgaccgaagtcttgccagcagtgttgtgacattgcaggcacaccgcgttgcccggtgctttcagttcattgctgtgcgggttgtggcaattgctgcagcgcacacccttgtcgaacatcttgctttgcaggaacgagccgtgttcgaacacttcgtccttgatcttgccgtccagcgcgtacagctcacgggtgagggggctcggcagataatcgtccatcaagcgtttgccgacggtgtagccgtcgcccaacggcgcacggcgcgcatggcagcgagcgcaggtttcgatctcgacggtggcgttcttgtccttgagatcgacgtcaaaaccctgatgaatcagatcgccttttttctgcgtccattccaggtgattggacgccggaccgtgacaggcctgacagccgacaccgaggctgttccactgactgttgaaggtgttgctggccgcatcaaaattgcgtttgaacccggtggtgtggcactcgacgcacatgaagttggcgttctggctcggcttgctccagtgcagcggattcttgaagttgacgccctggccgggatagagatgaaaccagcgatgtttctcggtatcccacgccacgccgagggcctgcaagcgaccttcgccaacctcaatcaggtattgctgcaacggcgcgatgccgaaggtgtaggcgactttgaagtcggcatgcttgccgtcgatgccgggcgtattgacccagaactcatcgcccttgcgtgaaaaacgcgtggtctcgttttcggccttgaaggtgatgttgttgaaatcgccgagcatcgtttcagcgttcgccggctgcatcgccaattggtgatgcgaaccttgccagtccttgacctgttcggtgtggcagccctggcattgttgttcatcgaccatcgtcgctggtttgcttgcgagcacggcttgcggcttggcggcgacaatgggggcgctgaccggcgcaggtttcaccggcaccgaagcggggctgaacagaaaccagccgatccccgccacggcggccagcagcacgccaatggtgatcgggaacagatattttgagggtgaagatcgagtcgaatcagggtcaggttgtgcggttttatttttatgcttgggcattgcgacttccgtagtccaggtgcatttgccgtctggcgtgcgttcaagctcgatgcagctttgccggatgacaggcgtctgtcaaatgaccgttgtgatccgccacgcagccttgcgtgaattttgtgctttgcaatcgcaattactgaggttttagctatacctgtaactcccccggcaaagtttttggccttctgacaggagttacagcatgaagctagcagtgatgatgggcactctgtgttttgccacgctcgcagtggtgggttgttccagcaaaaccgtcgacccgaaagagtactccggcttcctcaaagactacagccagctcaaggaggccaaatcgccgtccggtgccgaggtcatgcgctggatcgatccgaaggtcgacatcaagaaattcaccagcgtttatatcgaaccaacccagctctacccgaaaccgcaaccgaccgcgaagatctcccagcaaaccctcaatggcatcacttcctactacgatcaggcgctcaaacgtgaaatcggcaaagacttgccgttggcgactggcccaggtccgggcgtaattgtggtgcgtgcggcgatcaccgccgtgagcagcaagaccgaaggcctgcacgcgtatgaggtgattccgattgccctggtggcagcagcggtcagcacggccagcggtattcgcgatcaggaaacgacgttggccaccgaagcggtattcctcgatggcgcgaacaacaaggttatctcgcaagtagtgcgcaaaggcaccggcaaaccgttggaaaatgactcgcaggcgatgacggcgaatgacgtcaaaccggtgatcgatggctgggcttcagacatgcgtcagtcgtatctgaagcttaaggccggcaagtaagcgcacgaggccggattgtccgcgaggaccgtccggcctgtgcacaccctcagaagttggcgcgtgcctgacggttgtattggctgagcagggcgtcgtagccacgggtgacggcgtagtagtcgtcgctcaagcgttgcggttcggcgtggttctgccagtccttgtgcagggtgttcagcgcgtcgagatagctttgcgctggctcactgatgtgccgccacagctcccgcgcgtcatcgtccttgtttcgaaatccaccctcgcgaagagcaatgaagggcgcgcgacgattccacgcctgttgcagatcagcggtggtatcggccacggtttgcgggctcagggtgcggtgtttcatcccgttttctagcaactccagtgtctcccgagcctgaatcatgtacgccagcagcgaccagtggatctccttacccacgcgcgcttccaggagcctgagctgctcggggcgctgtgccacgtccagtggcagcagttcctctcgcaaggctgtcgatgcgttgatgtaggcattgctggcggcctggatttgccccgagccctgggacaaccgggcgagcggcgtggcataaaaattcgcacttctgtcgagtcgctccggcgtaaagatcaccgctgccccctgcagtgcttgcgcgtagtcacggactttttgcgaaagcactggctgataggccaagagttcgagtttttcgttgatatgactgaggcagagatccttttggatgtcctgcacggtgtacgcatccgtgttgtcgaaatcccgtgcctcagcaagataatgcccgaatgcatcacttgttggccgtggacgttcgaacttgtcgtaggcgttgcgccagtgcacatcgacacggttgacgcaggcgatgatcgggctcagcgcgttggcctgcgcggtcacgggggattcgcgctgatcaagccacagatcgagcttcaggaacggccgtgtcgcgctcgacagccccatcaccaccagaacgaccactacgccgctgacaaacatgaatctcgacgtcatggccgtgcctccgcgggataccactgctcgcgggtggccggagcgccgcaatcgaaagaactcgccggcaaccggctacacaaacgttccgcccagggttgtagcccctgattgcgattgaccgtgccttgactggcggccactttgaacacgcccagcaccagcaccagggcgacaaccccgagtagcgtcaggccgattttcaccggcaggttggtcttttcccaggacgtgtgtggtttgacctgacggcgacggatcaaacccacgcaggcctgtgtggcggcatagacgacgccagcgatggggccgaaaaaccagctgagcccggccaccatcaatacgcagggaatcagatcgcgcagtacgccgaacggcgcagcgtccgtggctaaacctggccacaaccgcgcgctgaggcggtcatccagcagccaatgggtgtgcgccagttcgtgagtcagccagttgatgcccgcagcgatcaccccaaacacgatcgttgaggtcatgacgatattgatcagcccggtgacgcgtagccccagtgggatgaaatgagtaaacgcaccgatcagacaggccagcaccacgccaaggtaggtcggccattcgtcacggccgagctcccagtcgcgccagaaaaacgcggtgccaccgggcaactctacgcagaccttcggatgattggcatacagcgccgaactcaaatgtcggcaatgctcccaatctttctcccgcaggcgccgggccagtgcgcgacgctggctgaacgggccgctgccgagcaacaggcgcgcggcgcggtgttcggcggtggcgggcggcgcttcggcgagttgacgctgctgcgccagaaaaagcggtgcttcatggcgcgcgaccagtcgcttccattcatcttgcgggcaacggttggccgggccggaatgccagccctggcccgcacaaacctgctcgaaaacagtggaggaccagtgttcgctgtccagtagcaatcgactcaggaacaggttgaaccacagtcgctgtacttcagcgtcgagccagaggcattgcgcgcactgtgcgtaagcgtgcaaaaaggccgcaatgtcctcacgttcgagggcctcgcgcagcggtcgagtaatgcgttcccgctgctgatcgagcaaatgttcgatggattcctcgtccagttccaagcgctgccaggcactgaaccagtgataggtctgcaccgcccaatcgaccataggcgctgatgtttgcgggttctcgatgcaatgctgcagcagggtctcttcgaggatatgcgcgcaaccctgctcaacggcgagggcatggcgctgttgcaactgcgcaaggctggtgccctgcagcgagcgagttgcttgttgcaaggcatcgacttcgaccacggtcaggccggtcaaatcccagctgtcgtcctgcgctgcgttgtcttcgttgtcttcgttggcctgcgcccattccttgtaattcagggcttgctcataggcgtcacgcaggcgctggaaaccctcggcgtcttcgtccggacgggtctgtttgagcagggcagcgtattgtcgtttgatactgcgcgtatcggcgtcggcggtgaggccaaggacggtccagcaactcattgcgtgtacaactccatgaaaaccttcgacgcggtccagtggtggcactttgattgtgcgcaccttatctgtttcgcgtcgaaaagtcctcagccgccgcttatttgccgacgaaccagcggaaatacgggttgctgccgtcgccgcgcatcacctcgccgatatcccgcgcccaggcatcgcggtcaccgtcataggcatgcaggctggcgcgatagaactgcatcaagcgctgacgatgactttccatacgctcattgaacccggcatcggcattgaccagtggcggcgcctgatagaggtccaacagtgccggcaacacccgcgtgatctccttgctgcgcacccaaggcgcatattcgatacgcggctgatcgtcggtcaccgcaggcgcatcggcagcgaagcgctcaagcccggcgcgatcggtgacccaggtcgccagcagggcggcggcggaaccgatgccgacatcctgcaaggtactgcgtacgctgtcctgctggaatcgtgcggtgatttttgccgcgtccagctccatcggtgtcattgaaccgaccaacaacatctcgtggaactcgctggtccacagcgaggcgtacgggaacacgtcaaggaaactgcgcaccagcgatcgcgagtcatcgatgttctgcgtcggcaacggcagccactgggcgacgatgcctttgtgctcaaggcgactcgccgctaactggtagaaatcccgcgaatacagattgaccacaccggccgcagagggcggtggcggctcgagggtgatcaggtcgtagctttgctcactgctcagcagttcctggcgcccgtcgcgcagacgcacatcgacgccgggatcgctggcggcgttgaagttgcctttgaacagtggtgcggctttgaccaccgacggcagcagctcggcgacgactcgatgttccagcccgggatagcgcagcatcgctccggcggtgatgccggtgccgaaaccgatcaccagtgtcgagcgtggctcaccgttgtgaatcaacagcggcagcaaggcttgcacgcgcatgtagcgcagtgagggcatggcatcaccggtgttcgacacgccttgaatgtacaaacggtggaaggtgttatcgccgcgaccttgagcaaccacggcgacggtgccgccgcggccttcttcatagaacgacaggctgccgttgcgcgcaccgggcagcagactggcgagtttgtcgaccggggtaaacacggcaaacgcaaccgcgagcagaccgagggcgaccacggcctgacgccggcctttcttgacgtgatgacctttgcgcacggcaaagtagccgatgccggcagcgatgagcgccagcaggcccagcgtgcgcaccagccccaatagcgggatcagcagaaagccgcaaagcatcaccccgacaatcccgccgagcgtattgaaagccaccacggcgccgacatcccggccgacgcgctcatggccgacactcaaacgcaacgccagcggaaacgccgcaccgagcaacaacgtaggcacaaagacaatgctcaacgctgccacggcgaagcgtgcgctcatgccggccagttcgctggcgcccagactcaacagccacatctccgcctgactttgcgcgatcaccagccagcgcccgagcacggcgatttccagcagcgcgagcaacccggcgccggcaatcagcaagccgaacacgccccacggatcgcggatccgttcgacccgccgggcgagcagggcgctgccgataaacaacccggtcagatacgtcgccagcaccacggcaaacgcgtaggtgcgcgtgctcatgaactgcacgatcgattgcgaccagaccacctcataaccgagcgccacgccaccggcgatggaatacagccacaacgcgctgcgatccggggctttttccgcatgatgtttagcgagggttgccactggcactggatgctgccgggccagccataacgcgccgatggctgccagcagattgagcatcgccgcgaacaacgcgctgcctcggacgccgaggctggcgatcaacacaaacgcggcgagcagggtgccgacaatcgcccccaaggtattggccgcatacaactgaccgccagccttgcccggatcggcggcgagcgaacgcaccagcaccggcagggtgccgcccatcaacaccgctggcaggccgaccaatgcgaacggcaatatccacgcgaacaggccgacatgctcttgcagccaggcaaaaggactggccgccaggctcatggccacggtcgcgccgacgccgagaatcgccaccagcacttccagcccggcatacaacaacaccggctgctgcaagcgatcggcccagcgcccgaacagccagccaccgatcgccaggcctgcgaaaaacgcactgataccggtggtaatcgcgtagacctcgacgccgaccaccagcgacagttgcttgatccacagcacctgatagaccagcgccgctgcgccggagatgcacagcagcagggcggggatcagcagcgccggggcgccggtgtgcgaggcgggtatggccgacggcttgctggcgatacgtgaggacatgcggaggccttaattcaagagtaactgtgactgtgctggccccttcgcgagcaggctcgctcccacactggacctgtggccaccacaaatcccctgtgggagcgagcctgctcgcgaagaagccgacacagtcccaagtcaaaaaaaggccactcgcctgtgagggcgagcggcagtcgagcggtgttactgggcttttttcattttctcttcaatgcggcgatccacgtcctcacgaatctggtcgatgctgaagctcgccggacgctggctcggtggatagtcgacgaaggtctgcaggaacttcgcagccctgcgggtgccgtcgaaaatcagatagtcgtttttcgtcagccagtcatagtattggtcagacacgatgtcagcccgttcgtacgggtccatgcgcaggttgaacattttcggtactcgcaggcacacgaacggttcgctccacacttccagaccaccgggagcacgctgctcacagaagaccagtttccaatcgttgaaacgcatgctgaccagcacaccgtcatcgttgaaatagtagaactcgtcgcgcgcgctcttgtcggttttgcccgtcaggtaatccagctggttgtaaccgtccagatgcaccttgaagttcttgccgccgacgtcggcgcctttgagcaggcgatccttgatatcggtgtcgccgaccgcagccaacagcgtcgggaaccagtcaagacccgagaacaactgcgtcgacacttcaccggctttgactttacccggccagcgaatcatcgcaggcactcgatacgcaccctcccagttggagtttttctcgttgcggaacggtgtggttgccgcatccggccacgaccattggttagggccgttgtcggtggtgtagaccacgatggtgttgtcggtcagcttgaggtcatcgagagtcttgagcagtttgccgacgtcgccgtcgtgctcgatcatgccatcggcatactcgttgccgaccataccgctctggccttgcatcgattcgcgcacgtgagtgaacgcgtgcatgcgggtggtgttcatccagacgaagaacggtttgttcgccttcgattgcttctcgatgaacgcctgagcggcggcagtggtttcgtcgtcgatggtctccatgcgttttttggtcaacgcgccggtgtcctcgatcttgccatcggcaaaactgtggatcacgccacgcggagaggctgccttgacgaactcggcatcattcttgggccagtacggacgctccggttcttcttcggcattgaggtgatagaggttgccgaagaactcgtcgaaaccatggttggtcggcaggtattcatctttatcaccgaggtggtttttaccgaactggcccgttgcgtaaccttgtgctttcaatgcttgggcgatggttatatcgcggggctgcaagccgactggcacgccaggcatgcccactttcgaaaggccggtacgcagcggcgtctgccccgtgatgaacgaagatcgtccagccgtgcaactgttctccgcatagtaatcggtgaacatcatgccttctttggcgatgcggtcgatgttcggggtcttgtagccaaccacccccatcgaataggcgctgatgttggtctggccgatgtcatcgccgaagatcaccagaatgttgggtttttcagccgctgtggccgttgccgacagcgccatgaccgaagtcgccactaaggcgagcttgggtagccacttgcgtatgcgagtcatctgacttgctccttttcgcgggggtcgtttattgcgactaacgtttattgcagtcctgcatcacgctttcttattgcacctgctcggttaccgctggctcgaacggatagatccggcgccattcggacgccatgtcgaccacggtccagccacgggaatttgcttcgtcgagggccttgtcgagccggccgatatcggatttgcggtcataggcccactcgcgtttggcgtcggtgtggtgcaccaggcccatgaaacgcttgccggaacctgcagcggtccactgcagcatctgcaggtcgccgtcggagttgccgaaggcaaggatcggccgtttgccgatcactgcgtcgatgctttccggtttgccggggccgtcgtcgttgtgcgccagtttcggtgtgcgcacgatcgaggcctggccgtccttgtattgaaacgaagtgatgaacgtggtgccgatcacctgctccggcggaatgccgtagaccttctcggcgaaggcacgcatgaaaccggtgtcgccgccggagacgatgtaggtcttgaagtcctgtttgcgcaggtagtcgagcatttccagcatcggctggaagatcatctcggtatagggcttgccggtttttggatggcgcgcctggctcagccaggtcttggcgtagtcatcgaaggcttcagtggtcatgccggtgtgcgttgcgccgacgatcttcagcaggccatccatgcccgacgcggcgagggctttgtgatcgttttccagcacggctttgaacggttgggtggtcttccattccgggtgctgcgcggcggtacgcttgatctcatcgaaggcgaacagcaattcgaaataggccggttgttcactccacaacgtgccgtcgttgtcgaacacggcgatgcggtcgcccggtttgacgaaatccttgctggactggtcggttacggtctgcacgaattcgataatgctcttcttcgccgggccgtcattccacgacggcagcggctcgttggcttgggccagcagcggcagggcgaggccaaacaacagggtcagggcgaatcgttggcggtgcagtagcgcaatcgtcatgggaaatccttctcgtgaacggggttgagcgggcgcagggccgaggccggttttgcctgttgctgttcggcctgactgtgaagcgtagtcaatgattcgcgcagatgaacgagtgtttgcccggtactcggctggcgaccgtaaagcccgcgtaacaggccttgcaggcgtgggccggcattgaccagtttcagccccaggcgactgcgccgcagccacaggtacagcgccgtcaattgcgccggactggcctgcagttggctattgatttgttgccaggcgaaagcaggggattgctgccaggcccgttgctgcgcttgccggcgtgcttgccactgttgcctggcgcggatgaacgcaggacgcagcagataaacggcggcaacgactgcggcaatcagcgtcagccacaacagccagcgcgtggagaaacgcaggtgattctggcccagtcgctgaaggtcttcgctgatcgaaaacaccggtttgtaggcagtgccggccgctgcttcgaaggtcaccgccggcacttgcgcgatgcgcggttggcgagtgctggcgtcccaccatttcacctcaacggccggcaggttgtgcgagccggccttgtcgatgcggtaggtgacgctgtcgatgcgttgaccgccgagaatgtcaccgcgaccgtcatccagtgcagtgacttgcggagttttcgcatagcggcttagcccggggatatcactcaacgccggaatcggcagggccatcgccagcgcgccgtccgcttgcagggtcaattggcgggtgatgctgtcgccgactttcaagggggtcgccgagtttgtgacggtctgggtgaaacgcaatccactggccaccagcggtgtttccccgggtttgaaaccgggcgtttgtgccacgctgaactgcaccggttggctttgcgcactgatttctgtcgtggcttggccgggtgtcgcgcgcacggtcagagaagggatatcaaacgtgcgcgcaacgttcggggtgatcaggtagctgtagcgcaaaccgctgaaagcctggccgtcgatggtttgattgaggtgctgggcctgaccgtctgggggcatgaccagcgcgccgtcgagtttcaggtcggggagggtggcggcgctggtgaaccaggtgtcggtgaggacatcgacttgcagttcgaccagtccgccgaccatcgcgccttcggcgggctgcaggtgggcctggactttgagttgggggtcggcggcgaaggcctggagtgtgaacaggccactgatgagcaaggtgctgagtgttcgggcgcctgtgctggccttatcgcgagcaggctcactcctacaggggattgttggcgcacacaaaaccaatgtaggagtgagcctgctcgcgatagccacgactcggttcatggcctggctccctcctgatcctgcaagctgaacttctgcctgagaaacttcgccggcgaggtggtcaggttctgcaaccacaaggcatcggacgcggcctgctcagtctgcacggctttgctctggcccttgcccggtgccttgtcgaatttcacctcgtcgggtttggtttccggggcgtttttctcggcgctctcggtgtccttcagcaaggcttgcgccagggccaggttggccgtggcttcgggaaactgcggttgcaacttcaaggcttgggtatacgcggcgatggcttcatcgaacttgaagcgccgcacgtaaatattgcccagatagaagtacgcctgcggcgtgtccagccgtgcgaatgtcgccagcgccaggtcgtaatcggccgcgtgatacgccgccacacctttccagtatgggtcgacaaacagcgccgctgcttgcggcagatgctcatgttcgaacgcccagcgcccttgctggtcgcgggtgaaaaacgcatcggtcagggcgttggcctgtgctggtgctgctggccagctcaagccaaccgccagcgccagcgccggcatccagttgacgctccagcccttgcgcacattgcacagcgccaacagcaacaacggccagcacagccagtaaccggcgtctttccagtgcaattcgcgctgctcggcgctggcactctgaaaatgctgctgcgcgtgcaactcgatccagtccagatcatcgtcattgacggtcaggctacccagtggcgcagcgacggcggaggccagttgcttgattgccgcctgatcgaagctgcccagcgccgggcggccgttggcatcggtgcgcggctggccgctggcgtcgtgaatgatgccgccgtcctcattgccgacggccagtaccagcacttgcaacggactgtcgcccagacgtttatcgaggccgtcgagttgcgaggtgtcggcaccgtcggtgatcaacaacagactgcccggagtcttctcggcgctgagcaagcgtttcgcctgatcgatcaccgcgccgacgtctttgcccggtttgtcgatcagcccgctgcccaaggcttgaatgaacgtgtcgagcagcgccggatcgtcggtgggcggcaacaccagatgcgcgctgccggcgtaagcgatcagagcagtgcgggcgccggcgcggcgctggatcaggtcgtgcagtttgtgtttcgccgcttccaggcgagtcggctgcacatcgctggcgtccatcgacggcgacagatcgacggcgacaatcagcggcgcgcggttctcgagaaagtctggtcgatcctgttcccaggtcggcccggcggccgcgactgcgccgacgatcaacagtgcgcacagcaggtgcaccgggcgcaggcgctgatggtcttgcggggtgatcagcaaatgcggcaacaggtgctcggcgatattgccgcgcaggcgtcgttgcaggtcgcgaccgcgacgccagagcaacggcagcgcggcgccgaacagtgcaaggatcagccatagcgggcgcaggaaatggaagtcgctgaggttgatctccatctcaggcctcctgtcgctgacgggtaaacgccaggcgcacacgcagcagagcgccaaggtgatacagcgccaacagggcaactgccgcgcccagcggccagtagaacaattcgcgttgcggttgatggctgagggttttcacttgatgcggggtcagtcgatcgagggtgctgtagacctgatccagcgcgttgcggtcttcggcgcggaagaactggccgccggtggttttggcaatctgctccagcgccgacaggttgaccttggcttcgccggatgcgctcgggtcgccgataccgatggtgtggatgatcacgcctttgttggcggccatttcagcggcgtgatcgggagtgatcgcgctgctggtgtcgttaccatcggtgagcaggatgaggactttttcctgttcgtgggccttgtcgagcagcttcaggctcaggccgatcgcgtcgccgatcgcggtgttgggcccggccatgccgatgccagtgtcggcgagcaacagcgacaggctggcgtgatcgagggtcagcggcgcctgcgggtaggcgccgctgccgaagacgatcaggccgagacggtcgtccttgcgcttatcgatgaagccttgcacgacttctttgacggcagcgaggcgattgattttttcaccgttggcgttgctgaagtcttcggtttccatcgactgcgaaaggtcgatggcgagcatcaggtcgcgcaccggttgctggcgttcgataggtttttcgataaacaccggacgagcagcagccaacaggatcagtgcccagaccagcacattgagcagcaactgccaggtgttgcgccgattgccgacgttgctcggtgcttcaccgactgcgcgactcatggcgctgaaaaacggcacgcgcactgcgctgcgcgcttcgttgtaggcgggcaggtatcggtaggccagccaagggagcggcagcagcaacaacagccatgggtaatcaagctgccacatggtgatgctccatccagtattggcaggtctcgaacagttcctgacgctgcggcgcggggagggcgcgcagggtttcgtcgggggcgtaggcgagttgtgcgagttgcgcgctgaagtctgccgggagcggtttcttacagtgttgctgcaaaaagacttgccaatcctccttccccagcgccgcaggaccctgtaggagtgagcctgctcgcgatggcgtccggtcagtcgatgcatgtgttgaacgtgatgacgctatcgcgagcaggctcactcctacagagatcgggttccagctcggggattgtgtgggcatcgacagcgccacgcgcttgagcagttccggcaattcgcgcaaggcattgaggtcatcgccgcgctcacgcaattgcgccagacgcgccaggccttcacgccgataagcgtccctgcgccattgcacgtagcgccgaatgccgatcaacaacgcggccaatatcagcagggcaagcaacacccaccaaccccacgtctgcggcgcataactgaccggcgcaggcaggcccagctccttaagctgttcgatgctggggatctgcggattcaccgccgtgccccggcacttttacccagctcggcgcgcagttgggcatgggcttcttctgcggtgctgatcatcatcagcggtacctgactgcggcgcagcagggtggcgacgtcctggagccgcccgctgagaaaatcccccagcggctgatgcacattgcgtttctcgatagccaattcaacctgcaactcgccttgggtgaccagcaggcgaccattgttcggcagcttcatcgccagcgggtcgtagacctgcagcgcaatcacatcgttgtgcgccgacagttgccgcatcagttgcaaggtacgctcgccagccccggcgaagtcactgacgatgcagatcaggtggtcgtgcccggccagcgcgagacagcgctgcaagactttgtccagttgatcctcatcctcggcgtcacggttgccggcgttcaaggcgcggttctgttcggcaatgcggctgagcagcgcttcgacgcgcttgcgactgcgcagtggggcaatgctgtcgatgcgttggtcgttgaacaccagcccgccgacccggtcgccggcatggaacaccatccacgccgcgagtgcggcgagttcggcagccacggcggatttgaagctgcgttgcgagccaaagaacatcgacatgcgttgatcgaccacgagcagcgccggccgatcgcgctcttcggtgaaggtgcgcaccaccggtttgccggtgcgcagcgaggcgcgccagtcgaggtggcgcaaatcatcgcctggctgatagcggcgcagttcgtcgaagttcaagccacggccgcgcaagcgcgaggcgtgattgccggcaaggatgctgccttgcggctggcgggcgagaaaactcaggtcacgggccttgaactccagcgccatcagttgcgcgagagagacgtagaccaggccttcatcgttcatgccggaatcgccactttatcgagaatccggtcgagtacctgatcggcactgacgccgtcggctaccgcgtcatagctcagttgcagacgatgacgcagcaccggatgcaccacggcgcgcacgttgtccggcgaaacgaaatcctggccctgcaaccacgcatcggcacgcgcacaacgatccagaccgatgccgccacgcgggctggcgccgatgctgatccagcgcgcgaggtcttcgtcatagtcggcagggtggcgggtagcgttgatcaggtcgatcaggtagctgtcgatggccggcgacacgtgcacggcgctgacctctttgcgcgccgcgaagatcacatcctgcgcgaggctgaaacccttgatgggtgtggtgctcgcaccttgagcgaattcttcgttgcgcaacaggcgcagcacctggctctcgttttccgcgctcgggtaatcgagcaggactttcatcagaaagcgatccatctgcgcttccggcagcgggtaagtgccttcctgctcgatcgggttttgcgtcgccaccacgatgaataattcgggcaatgcatggctgttgccggcgacggtgatttgccgttcttccatggcttcgagcagcgccgcttgcactttggcgggggcgcggttgatctcgtccgcaagaatcaagttgccgaacagcgggccgggctggaagcggatttcattcttgccttcgacctgatgcagcacctcggcgccagtgatgtccgacggcagcagatccggggtgaactggatgcggctcatcttcgcgtcgaggtgtttggccagtgctttgaccgtgcgggtcttggccagccccggcagactttccagcagcaagtgaccgttggccaacaggccgaggaggatttggcgaatcacctgatcctggccgagtacggcttcggcgatgctggcttgcagggcattgaggtcggtaagtgcggtcatggcagcagtcctttgtgtccggtctagaaaaacgccagggtcaggttgacgctgaagccgttgccctcggggcgattcttggtgtcgaattccggcacccagcgggcgctgatgttggcttgggcatcggcgaatttgccggtccagccgagcaccggaccggcgcccacagaacgtccgcgatagccgttgaacgtgttggcggtctggcctttgtcgtcggtcagttgttggatataaccggcggcaacgccggcattccagccttcgccaaacccgagggtccacagggcatcgaggcggaagatgttgccgttgcggtaatcggtagcgtcgttttcggtgtagcgctcgaaagcgctcatgaggctgaattcgccacccttgccatccagatgagtgaacgccacggtcggcatgaacgtgtagttgttctgtcccgggttggccaggcgatccttgttgtaggcaccggtgggcacgtagatcggcagcgaaaacgagatgtggttcagctcatcgaagtggtagccggcggcaatcggcgtgatcaaggcgtcggcgaattgtgtgccggaatcgctgtcgcccagcgtgcggccgcgcgggccggagatactcgctttgatgtcggtgtactgcaccggcacgccgatcgccgaggcgtagttccagcgacccttgccggtgtcccagacgtgggtgaagttgcccatggtgtaggagactttcatgtcgatcccgccactgacggcaccggaaatcggcgcgccggaactgcccttgagcgagccgtcgtaccagatgctggtcagcgacatgacccagcccggttcgggcgggactatcccggcgttggaaaacacctgctggccggtgatcggtcggccaacgccaccctctgctgcgtaaagcagaggactgccgatcatgcacagcgccagcaatgggcgcactacgttgggcttgatcatcaaaaactccgcttattgttttgaattgatcgggttgagcaacggcattttccattcaccactggcgacttccggtgtcggcatatcaaggcgaacaatctcctgtgccgacccgtttggcgtcgtggggcatttgggttgctgggcgccgacaccacagctgacaaacatgatcatcaggccgtatccagtggctttgaaaatagcgtgcatggcgttttccttatttgccgaatgtcacgttgatgccggtgtacacgacgaactgcggcagcccgtcgcccttgcggtcgaccgtccactgcggctcgacgaaggcgttgaggatgttgctgccggacttccaggctttgccgacacccagaccgagcgggatgtagtgcgtgtcgtttttcaggtcgaaagtccaggtgccggtagagcgcagataccagcctttttccaggttatggatgatgaacggctgcatggtggcgctctcgacgtgcgggcgatcgttgtcgccggcaaacgaactctggtactgcaccagagcgccaagcaacccgcgcggcgaagcgtcgatggccaccgctgccagaccgccttgccatttgccggtaccgagctcgtcctgttcagcggtcggcgcggtgatcaacggaccgatgcccaactgcacgccttcggttttcagaatgaagatatcgaacaggttcagatcgccgatgccggtgctgtatccgttatgcgggtctgggcgagtgctgatcggcagcgtcgcgcgaaccagttgcggcacgccgatgaaatcgttcggcgcgatcggcagggtgccgcgcagcaacacgtcattgctgtgcgcattgctgtcgtagagtttaggggtgtagtaatcctgcagattggcgcccggtgcgacgttcaacgggttgttgctcttgttcgagtcctcggcgttatccgcctgtgccgcacacgcagccgccagcgaactcgccagaaaaagagtcttccccactcgattgaacatcatccccgattccctggtggcttatagacagctcggcactctcgtcggcacttctcgaccgttacggcgtaatccctttcttatcaagcctgtaggacacgtctgaatgacgctagcagctaatcgggagttagccagtcgaatggattaattctttggttttgtgtacgggttcacggattgttgtgtactgaatagtccgtttctcaccgtgtaggagctgacgagtgaaacgaggctgcgatcttttgatcttgtgttttaaaagcaaaatcaaaagaccgtccgatcgcggcccgagccttcggcagcgtctacctgtgcgtatttcaattcgggatgtttaaagattgtttggaatttgcggaacgttcccacaaggttttcaggttgtccgtcggacgtcgggtctctagcctgtgttcgtcgctgccaaatcagcgaccgggactggaaaccccgacgggtattagtggcgcgtacacgcctttcataacgtatccttgcgcacttcgaatgtgtgcagtccgttatggcggctgtgcgcgggagaccttcgggtcgaccgggtcgccgctgcccgggtttccaacctgcgtacagctgccacctcttcgtccggaaaccgaatgcggcagctccaactttccagtggagttccaccatgaaaaagccaacacccaaccccccagaatcagacgccgacagcacatccccctacgcttcagtcgacagtaaaaaactccacgaagccgccgaccgcgccctcgactactacctcaatcccgccgcccacatcatgtccagcgccaacgagccggaacccatgtacctcgccaatcccaggtacaacaccgaatccctgctcgccaacgccagcgaaaccctcggctcggccagcgaaatgctgatgaacttcgccgcttcgctggaaacctcccagcgcaagactgcactgggcatcgcacaagtcgtaatgctgggcgaactggccgtcaaccaagccctcgatcacgtcgagttgaaggatggctgattgattgatcgttcccacgctctgcgtgggaatgcagcccctgacgctctgcgtcaaattcgcaatttggaacgcggagcgtcccgagaggcattcccacgcagagcgtgggaacgatcaagatccgctctatgcccgagtgatcgattctgtagctgtcgaatgaaacgaggctgtgatcttttgactttgcttttcaagatcaaaagatcgcagcctgcggcagctcctacagggaggagttggtttagccgtttttcttggcttgttcgcgaacgcgttcttcctgcgcacgtgcttcgggggtgaactcggcgccgaagtcttctgcagaaaatatctggcggatttcaatatcggactcgcccggcatcgggttagggcagcgcttgacccattcgatggcttcttcttttgatttcacttcccagatccagtaacccgccaccagttctttggtctcgatgaacggcccgtcgatgaccgtgcgtttgtcaccggagaagcgtacgcgggcgcctttgctgctcgggtgcaggccatcggcgtcgatgagaatgccggctttgaccagttcttcgttgaagttgcccatggcggtgatcagttcttcgctgggcattgatcgttcccacgctctgcgtgggaatgcagcccctgacgctctgcgtcaaattcgcaatttggaacgcggagcgtcccgagaggcattcccacgcagagcgtgggaacgatcaagatccgctctatgcccgagtgatcgattctgtagctgtcgaatgaaacgaggctgtgatcttttgactttgcttttcaagatcaaaagatcgcagcctgcggcagctcctacagggaggagttggtttagccgtttttcttggcttgttcgcgaacgcgttcttcctgcgcacgtgcttcgggggtgaactcggcgccgaagtcttctgcagaaaatatctggcggatttcaatatcggactcgcccggcatcgggttagggcagcgcttgacccattcgatggcttcttcttttgatttcacttcccagatccagtaacccgccaccagttctttggtctcgatgaacggcccgtcgatgaccgtgcgtttgtcaccggagaagcgtacgcgggcgcctttgctgctcgggtgcaggccatcggcgtcgatgagaatgccggctttgaccagttcttcgttgaagttgcccatggcggtgatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagaatgccggctttgaccagttcttcgttgaagttgcccatggcggtgatcagctcttcgctgggcatgatgccggcttccgagtcgacgctggctttgacaaggatcatgaagcgcatggcggttactccgtggattgtggggattcattgcttagtcgaacgggccgggcttgaatcgacagggcctctggtaaaagatgcggagaattttttcacaccgcagatctcattgtaggagtgagcctgctcgcgatggcggtgggtcatatacgcagatgctgactgacagaccgctatcgcgagcaggctcactcctacagaggaatggctgtggttttgtatacaatttttcgcgcaggcacccaacaatttccaaacagggcataggtcgtcggacaatttcgtggttaacttcggcctcttgcatgctttccaatcaaaacatcagaaggactcaagtcatggctcaagtcaccctcaaaggcaatccggttcaagtcaacggccagttgccacaagccggttccaaggcgccagccttttctctggttgccggcaatctgtccgacgtcaccctgaaagactttgccggcaagcgcaaagtgctgaacatcttcccaagcgttgacaccccgacttgcgccacctccgtgcgcaagttcaacgctcaggccagcgaagtggctaacaccgttgtgctgtgcatctccgctgacctgccgttcgcccaggcgcgtttctgcggcgccgaaggtctggaaaacgtccagaacctgtcgaccctgcgcggtgccgagttcatcgagaactacggcgtggccatcgctgacggcccgctgaaaggcctgaccgctcgcgccgtcgtggttctggacgaaaacgacaacgtcctgcacagcgaactggtcaaggaaattgctgaagagcctaactacgaagcggcactgtccgttctcaagtaagcgcttttacaattgttaacggcctggccctgtccaggccgttttcatttgtgtatcagtgttttgcctcacaccttgaaacgtaaggtgtaagtaaattgccggtaaagctgctttgctaattccccatcagtgcttatcgttcagcctcccgtaatagaagcccacgcgcccaatggttaatcactccatgcaatcgtccccccgtaactcccgtcgctggctgatcagcctgcttgtcctgttggtgatcgccgttctgtgctggaaattctggccggccggttcagcccacaaggagggcgctgacaaggctgctgccgggcatgccggacgttcggggatgatgcggccgggcttcggtggcggcaccgggccgattccggtgcgggtggcgccggcggtcaccggcgactttccgctgtactacaaggcgctgggtacggtgaccgcgctcaacaccatcaatgtgcgcagccgtgtgggcggcgagctggtcaagatcaatttcgaagaaggccagatggtcaaggctggtgacctgctggccgagatcgacccgcgtccctaccagaacgccttgctgcaggccgaaggcaccttgctgcaaaatcaggcacagctgaaaaacgcgcaggtcgacgtcgagcgttatcgcggtctgttcaaagaggacagcatcgccaaacagacgctggacaccgccgaagcgctggtcggtcagtatctgggcacggtcaagaccaatcaggcggcggtcaatgacgccaaactcaatctggaattcaccaagatccgcgcgccgattgccggccgtgtcggtctgcgccagattgacgtcggcaacctcgtcaccgccaacgacaccacgttcctcgcggttattacccagacacaaccgatcagcgtcgctttcaccttgccggaaaacagcctcgaaacagtgctcgcccgctatcgcagcggcgccaagctgccggccgaagcgtgggatcgcggcgacaccaaactgcaggccactggtgttttgcaaagcctcgacaaccagatcgacgtcgccactggcaccctgaaattcaaggcccgctacgaaaaccgcgatcaggcgctgttccccaaccagttcgtcaacgtgcacttgctggctgacacgctgaaaggcgtggtgctggcgccgtcggcggccatccagttcggcaccaacggtaccttcgtttatgcgctggacggcgacaagaaagtcaccattcgccagttgaagatcggcgccagcgatggcgaaaacaccgtcatcaccgaaggtctggccgctggcgaccgcgtggtgctggaaggcaccgaccgcctgaaagagggcagtgaagtggaagtggtcaacgatagcaatcaagtgccgaccaccccgaccgaacacctgcaaggcaaatccgccgccaacgcaccggatgctgcggtcactgacaaggccaagaagggcgcatgaacatttcgcggctgttcatcctccgaccggtagccaccaccctgagcatgctggccattgttctggccggcctgatcgcttatcgcttgctgccggtgtcggcactgccacaggtcgactacccgaccatccgcgtcatgaccctgtatcccggcgccagcccggatgtgatgaccagtgctgtaactgcgccactcgagcgccagttcgggcagatgccgggcctgacgcaaatggcctcgacaagctccggcggcgcgtcggtgctgaccctgcgtttcagtctcgatatcaacatggacgtcgccgaacagcaggtgcaagccgcgatcaacgccgcgaccaatctgctgccgaccgatttgccagcgccgccggtgtacaacaaggtcaacccggcagacaccccggtactgaccctggcgatcacctcgaaaaccatgctgctgcccaaactcaatgatctggtcgatacgcgcatggcgcagaaaatcgcccagatcagcggtgttggcatggtcagcattgccggcggtcaacgtcaggccgtgcgcatcaaggtcaatccggaagcgttggccgccaacagcctgaacctgtcggacgtgcgcaccttgatcggcgcttccaacgtcaatcagccgaaaggcaacttcgacggcccgacccgggtgtcgatgctcgacgccaacgaccagctgacctcgcccgaggattacgccaacctgatcctcgcctacaagaacggcgcgccgttgcggctcaaggacgtggcggaaatcgtcgatggcgccgagaacgagcgtctcgcggcgtgggccaaccagaatcaggcggtattgctgaacatccagcgtcagccgggtgccaacgtcatcgaagtggttgaccgcatcaaggcactgctgccgagcatcaccgacaacctgccggccggcctcgatgtcaccgtgctgaccgaccgcacgcagaccatccgcgcctcggtcactgacgtgcagcacgaattgctcatcgccatcgccctggtggtgatggtgacgttcctgttcctgcgccgcgccagtgcgacactcattccgtcggtggccgtgccactgtcgctgattggcaccttcggcgtgatgtacctggccgggttctcggtcaataacctgaccttgatggcgctgactattgccaccggttttgtggtcgacgacgccatcgtcatgctcgagaacatcgcgcgcttcatcgaagagggcgacagcccgatgcaggccgcgctcaagggcgccaagcagatcggctttaccctgatttccctgaccctgtcgctgatcgcagtactgattcctctgctgttcatggcggacgtggtcgggcggttgttccgtgagttcgccatcaccctggccgtggcaatcctgatttccctggtggtctcgctgaccctgacgccgatgatgtgcgcacgtttgctcaaacgtgaacccgaggaacatgaacagggccgtttctaccgagccagcggcgctgtcatcgactggatgatcgccgagtacggtcggatgctgcgctgggtactcaagcaccagccactgaccttgctggtggccatcggtacgctggcattgaccgtgttcctctatatggtcgtgccgaaaggcttctttccggtgcaggacaccggggtgattcagggcatttccgaggcgccgcagtcgatttcctttgccgccatgggtgagcgtcaacaggaactggcgaaaatcattctcgaagatccggcggtgcagagcctgtcgtcctacatcggtgtcgacggcgacaacgccacgctcaacagcggccgtttgctgatcaacctcaagccccatggcgatcgtgatctgaccgccactgaggtgattgcgcgcctgcaaccacaactggacaaactggtcggcatccgtctgttcatgcagccggtgcaggacctgaccattgaagaccgcgtcagtcgcacgcaataccagttcagcatgtcctcgccggactccgaactgctcagccagtggagcggccgactggtcgaagcgctggcgcagcgtccggaactgaccgacgttgccagtgatttgcaggacaagggtttgcaggtgtatctggtgatcgaccgcgatgccgcttcccgccttggcgtttcggtggcgaacatcaccgatgcgctgtacgacgcttttggccaacgccagatctcgacgatctacacccaggccagccagtaccgcgtggtgctgcaagctcaggccggggaaaagatcggcccgcaggcgctggaccagattcacgtcaagaccaccgacggcgcacaggtacgcctgtcgagtctggcccatgtggaagaacgtcaggcgcaactggcgattacccatatcggccagttcccggcagtgatgatgtcgttcaacctggcgcccggtgtagcgttggggcatgcggtcgatgtcatcgaacaagtgcagaaagacatcggcatgccggtcggcgtacaaacccagttccagggcgcggcggaagccttccaggcctcgctgtcgagcaccttgctgctgattctggcggcggtggtgaccatgtacatcgtgctgggcgtgctgtacgagagctacattcacccgatcaccattctctcgaccttgccctcggcggcagttggcgccttgctggcgttgctgctcagtggcaacgatctgggcatgatcgcgatcatcggcatcattctgctgatcggtatcgtcaagaagaacgcgatcatgatgatcgacttcgccctcgatgccgagcgcaatcaggggatggcgccgcaggaggcgatctatcaggccgcgctgctgcgcttccggccgattctgatgaccacgctggcggcgctgtttggtgcggtgccgttgatgctcgccacgggttccggggctgaactgcgtcagccgttgggtctggtgatggtcggtggtctgctggtgagccaagtgctgacgctgttcaccacaccggtgatctacctgtacttcgaccgtctcggacggcgctttggcaagaccaatgcggatgccgaagaggtctcggtatgactgtccgtacacataacccctgtaggagtgagcctgctcgcgatgaggccggcacattcaatatcagtgggggcagacacaccgctatcgcgagcaggctcactcctacaggggatgggtgtgaagtcggagtttgtggtcaatgaacctctccggtcctttcatcaaacgcccagtcgcgacgatgctcctgagcctggcgatcatgctgctcggcggtgtcagcttcggcctgctgccagtggcgccgctgccgcaaatggattttccggtgatcgttgtgcaggcgagcctgcccggtgccagtccggaggtcatggcgtccaccgtggccacgccgctggagcgctcattcggcgcgatcgccggcgtcaacaccatgagcagccgttccagtcagggttcgacccgggtcattctgcaatttgatctcgaccgcgacatcaacggcgccgcgcgggaagtgcaggccgcaatcaacgcctcgcgcaacctgttgcctagcgggatgcgcagcatgccgacctataagaaggtcaacccgtcgcaggcgccgatcatggtgctgtcgctgacctccgatgttctggaaaaaggccagctctacgatctggcctcgaccattctgtcccagagtctgtcccaggtgcagggtgtcggtgaagtgcagatcggcggcagttcgctgccggctgtgcgcatcgaactggaaccgcaggcgctgaaccagtacggcgtggcgctcgacgatgtgcgcaagaccatcgccgatgccaacgtgcgccggccaaaaggttcggtcgaggacggtcagcgcttgtggcagatccaggccaatgatcagttggaaaaagccaaggattacgaatcgctgatcatccactacgccgacggtgccgcgttgcgtctgaaggacgtggccaaggtcagcgacggtgtcgaggaccgctacaacagcggcttcttcaacgatgacgccgccgtgctgctggtgatcaatcgccaggccggtgccaacatcatcgagacggtcaacgagatcaaggcgcagttgccggccctgcaagcggtgttgccggccagcgtgaagctgaatctggccatggaccgctcgccggtgatcaaggcgacactgcatgaagccgagatgaccttgctgatcgccgtggcactggtgattctggtggtgttcctgttcctcggtaatttccgcgcttcgctgattccgaccctggccgtaccggtgtcgctggtcggcacctttgcggtgatgtacctgtacggattttcgctgaacaacctgtcgctgatggcgctgattctggccaccggtctggtggtggacgatgccattgtggtgctggagaacatctcgcggcatatcgacgagggcgtcaaaccgatgcaggctgcgtacctcggggccaaggaagtcggtttcaccttgctgtcgatgaacgtttcgctggtggcggtgttcctgtcgatcctgttcatgggcgggattgtcgaaagcctgttccgcgagttttccatcaccctggcggcggccattgtcgtctcgctggtggtttcgcttacgctgacaccgatgctctgcgcccgttggctcaagccgcacacgccggggcaggagaaccgtctgcaacgctggagccgccgcaccaacgactggatggtcggcaaatacgccagcagcctcgactgggtgttgcgccatcgtcgtctgaccttgctcagtctgctgatcaccgttggcgtcaacgtcgcgctgtacgtggtggtgccgaaaaccttcatgccgcagcaggacaccggccagttgatcggtttcgtgcgcggtgacgatggtctttcgttcagcgtgatgcagccgaaaatggaaatcttccgccgtgccgtgctcaaggacgaagcagtggaaagcgtcgccgggttcatcggtggcagtaacggcaccaataacgccttcatgctggtacgtctgaagccgatcaaggaacgtcagctcaatgcacagaaagtcatcgaacgcctgcgcaaggaaatgcccaaggtccccggtgcgcaattgatgctgatggccgatcaggacctgcaattcgggggcggccgcgaacagaccacctcgcaatacagctacatcctgcaaagtggtgatctgggtgagttgcgcaagtggtatccaaaagtggttgctgcgttacgtgcgttgcccgaactaaccgcgatcgatgcccgtgaaggcaagggcgcgcagcaagtgacgctgatcgtcgaccgcgatcaggccaaacgcctcggtgtcgacatggacatggtcacctcggtgttgaacaacgcctacagccagcggcagatttcgacgatctatgacagcctcaaccagtatcaagtggtgatggaggtcaatccgaaatacgcccaggacccggtgacgctcaagcaggtgcaggtgatcaccgctgacggtgcgcgggtgccgctgtcgaccttcgctcattacgaaaacagcctggaggacgaccgcgtcagccacgaaggccagtttgcctccgaagacatttccttcgacatggccgaaggcgtgacggtggagcagggcagtgccgccatcgagcgggcgattgccaagctcggccttccggaagacgtgatcgcgaaaatggccggcaccgccgacgccttcgccgcgacgcagaagagccagccattcatgattctcggcgcgctgctggcggtgtatctggtgttgggcgtgctgtatgaaagctacatccacccgctgacgatcctgtcgaccctgccgtcggccggggtcggcgcgttgctgtcgatctatgcgctgggcggcgagttcagtctgatttcgttgctcgggctgttcctgctgattggcgtggtgaagaaaaacgccattctgatgatcgacctcgcgctgcaactggaacgtcatcagggcctgtcgccgctggagtcgattcgcagtgcctgcctgcagcgtctgcggccgattctgatgaccacgctggcggcgattctcggtgccttgccgttgctgctgagccgggccgaaggcgcggaaatgcgccagccgttgggcctgaccatcatcggcgggctgattttcagccaggtgctgacgctctacaccacgcctgtggtttacctctatctcgacaagctgcgccatcgtttcaacaaatggcgtggcgtgcgtactgacgccgctctggaaactccgctatgactgaccgttcgcttttcaatctggccactgttcgcggctcgcgtctgctgagcctgtcactgtgcgtggcgatgctcagtgcctgcgccgtcggcccggactaccagcgtccgcagaccgctgaaattgcccagtacaaggaggccgaaggctggacccaggccaacccgagcgattcgctggcccgaggtgcctggtgggagctgtatggcgatcaacagctcaacgggctgatcgaaaaactaaacagctccaaccagaccgtcgcgcaatcggaagcacagtttcgtcaggcccaagccttggtgcgcagcgcacgcggggcgttctatccgagtgtcgacctcagcgtgggcaagacccgttccagccagggcaccggcagcagcagttcgagcctgagcagttcctccagcggcatccgcgatacttacaacgctgagctgggcgtcagttgggaagccgatgtctggggcaagctgcgtcgcgggctagaagccgatgaggccagcgcccaggccagttttgccgatctggccgccatgcgcctgagccagcaatcggaactggtgcagaactacctgcaactgcgcgttatcgaccagcagaaacgccttctcgaagccacggtcgccgcctacgaacgctcgctgaaaatgacccagaatcagtaccgcgccggcgtttccgggcgcgatgcggtcgcgcaggcgcagacgcaactgaaaagcacccaggccgatctggttgacctgatctggcaacgtgcgcagttcgaaaatgcgattgcggtgctcaccggtcaagcgccggcggatttcaacattgccgaagtgcagaccattccgaagttgccgcaggtgccattgagcctgccctcgcagttgctggagcgtcgcccggatattgcttcggccgagcgttcagtgatcgccgccaacgccaacatcggtgtggccaaagcggcgtattacccggatctgagcctgagtctgagcggtggctacagcagcagtacctcgcagaacctgatcagcctgccaaaccgcttctggtcggtagggccgaaactggcgctgccgctgttcgacggcggcattcgttcggcggaagtcgatcgcacggaagcggtgtacgaccagaccgtggccaagtaccgccagaccgtgctcgacggtttccgcgaggtggaaaattatctggtacagctcaaggtctatgaggacgaagcggcggtgcgccaggaagccctcgatgctgcccgcgactccctgcgcctgacggaaaaccagtacaaggccgggctgattgcctacatcgatgtggtggtggtgcaagccacggcgttgagcaacgagcgcagcgtgctgaacattctgcaaagccgcttgattgccagcgtgcaattgattgcggcgctgggcggtggctgggacgggcagctggatgtcagcgataacacccgctgaaggttggcttcactgatcgttcccacgctccgcgtgggaacgcctcaacggacgctccgcgttcggctttgaagggacgcggagcgtcccgggctgcattcccacgcggagcgtgggaacgatcaaatcggaggacgtattcgcgagcaggctcgctcacacagtgagttgcgcaagctgcagaaaggcccactccagagccttgtcggacgatcgaacaagcgtttcatcggcttgatggccatttgattactttgtcagtgcgttcttctgtgcaatcagtacaatcgccgcatttgcccgaccgggaatggacgcaatacgcgttgggtggccacgagaaatcccatgctcatcggtagttattcctccaccctggttttcatttcgttgtgtgtggcgattctcgcttcgtacaccgcactcgacctcaccggtcgcattgccaccgccaagggccgtgccgtgcatttctggaccgccggcggtgcgtttgccatgggcatcggcgtctggtcgatgcacttcattggcatgctggccttcaaactgccgatcgatctgggctatgacatcaccctgacggcgctttcgctgctcatcgcggtgttgtcctgcggattcgccttgtggctggtcagccagccgaaactgccattgctgcaactggcattcggcgcgctgatcatgggcagcggcatcagcgccatgcattacaccggcatggcggcgatgcgcatgacccccgggatcgactacgacccgacgctgtttggtgcctcattgctgattgcggtcggcgcgtcggcggcggcgctgtggatcgccttccgcttgcgtcagcactctccctatgtgcggctgatccgtggtggcgcagcgatcatcatgggcatcgccatcgttggcatgcactataccggtatggctgccgcgcaatttcccgacggcagcttctgcggtgcgacgatcaatggcctcaaaggcaacggcctcgacagtctggtgttgatcactacgctggcagtgctgtcgattgccttgctgacctcgattctcgacgcgcgcctcgaagcgcgcaccgccgatctcgcgcactcgttgaccgtggccaaccgcgaactcacgcaactggccctgcacgacaccctgaccggtttgccgaatcgcatgctgctggacgatcgcattaatcaggcaatgaaaaaggtccatgagcagggcggctgttttgccttgatgttcatcgatctggacggcttcaaaccggtcaacgatgcgtttggtcatcacatgggcgatcagttgttgcgcgaagtcggtgtgcgtctgcgtgaagacttgcgcagcctcgacaccctcgcgcggattggcggcgatgagttcgtcctgctggtccgtctgactgagccgaacgacgcgctggggctggcggcgcgccaggtcggcttgattgcgcaatcgttccgcgtcgccgagcatgacttgcagatctccgccagcgtcggcatcgccctgtatccgggcaatggccagaacgcccaggaactgctgatgaacgccgacgcagcgatgtaccacgccaagggcggcggcaaaaacggctacagctttttcgacgcatcgatgaacaccaacgcgcgcaagcaattgcagttgttgcaggatctgcgtgcggcgctggaacacagccagttcagcttgcattaccaacccaagttcgacgccgccaatggccgtccggtcggcgctgaagcgctgttgcgttggcagcatcccgtccacggcatgctgatgccggacaagttcatcgaactggccgagaaaaccggtctgatcattcccatcggtgaatgggtgctcaacgaagcgtgccggcagatgcgcgagtggtacgtgctcggttacaccgattggcgcattgcggtgaatctgtcggcgttgcagttctgccacaccggtttggtccgtagcgtggccaaggccttggccactcaccacttgccggccaacagcctgaccctggaaatcaccgaaaccacggccatgagcgatgccgatgccagcatgacggtgttgcaggagttgtcggacatgggcgtcgacctgtcgattgacgacttcggcaccggttattccagcctgatgtacctcaagcggttgccggccaatgagctgaagatcgatcgtgggtttgtgcgcgatctggagcatgacagtgacgatgcggcgattgtctcggcgatcgttgcgttgggccaggcgttggggttgcgcattgtcgctgaaggcgtggaaaccggagtgcagcaggagtttctgacgcagttggggtgtgattcgttgcaggggtatctgctggggcacccgatgccggcggagaaattcatgcaggatattgcacggggtgagcagttggcggtggtctgatcgactgcgttatcgttcttcgcgagcaggctcgctcccacattggctgtgtgaacgacacagaaccctgtgggagcgagcttgctcgcgaaggcgtctgcccagacaccacagactccatgcaaaacccgccaatggcggttattcttccccccgactgttacgtgtgcatttgggggaaaggccagcatggataaagtcattgtgatcaccggtggcgggcgcgggattggcgccgctacggcgttgttggctgccgagcagggatatcggatctgcatcaactatcagtcggatgaacaagccgcgcaaagcgtgctggagcaagtccgcgcactgggcgcacaagccatcgcggtgcgcgccgacgtcagcatcgaagacgaagtgatcgcgctgttccagcgggtcgacactgaattgggccgtgttactgcgctggtgaacaatgccggcaccgtcgggcaaaagtcgcgggtcgacgaaatgtccgaattccgcattctcaagatcatgaaaaccaatgtcctggcgccgatcctttgtgccaaacacgcgatcctgcgcatgtcgcccaagcacggcgggcagggtggcagtatcgtcaacgtgtcgtcggtggcgtcgcgtctgggctcgccaaatgaatacgtcgactacgccgcgtccaaaggcgcgctcgacacttttaccattggcttgtccaaggaagtggcgggtgaggggattcgggtcaacgccgtgcgcccaggctacatctataccgatttccacgctttgagcggcgacccggatcgggtcagcaagctggagtcggcgattccgatggcccgtggcgggcggccggatgaggtggcggaggcgattgtctggttgttgtcggataaagcgtcgtatgcgaccgggacgtttgttgatttggggggcgggcgctgatcgttgggatttttgttgcctgatccggccccatcgctggcaagccagctcccacaggtttctatgtcgtacacaacatacgcggtgacatagaacactgtgggagctggcttgccagcgatggggccagtgcagtcagcaacaatctttcagaacgaccgcacaatccgccccaacgtctccatggctttttccgaatcctcggtccaagggctgccatagttcaggcgaatacaattcctgaagcgctgcgtcggcgagaaaatcggccccggcgcaatactgatgccttgcgccagtgccatctgaaacaacttcaatgaatccatttgcggtggcagttccagccacaaaaagtagccgcccgccggttggctgacccgggtctgcgccgggaagtaacgggcgatggcggcaagcatcgcgctctgctgttcttccagtgcatagcgaagtttgcgcaggtgacggtcatagccgccgtgttgcagatagtcggcaatcgccgcttgcgccggcatcgaggcacataacgaagtcatcagtttcagccgttcgattttctgcgcgtaacgcccggcagcgacccagccgatgcgatagccgggggccaggctcttggcgaacgagccgcagtgcatcaccagaccttcggtgtcgaaggccttggccggtttcggcgcctgttggccgtaatagagctcggcgtagacatcgtcctcgatcagcggcacctgatggcggcgcagcagttcgaccagttcctgtttttttgactcgggcatggttgcgcccatcggattctggaaactggtcatacaccagcaggccttgatcggatgccgttccagcgtctgcgcaagtacgccaaggtcgatgccgtcacgcgggtgcacggggatttccacggctttgagtttcagccgttccagtacttgcaggctggcgtagaacgccggggcttcgatggccactaggtcgccgggttcggtcaccgcttgcaggcacaggttcagcgcttcgagggcgccgttggtgatcagcagttcttccattggcagcatcaggccgccgaccatgtaacgcagggcgatctgccggcgcagttgcggattgcccggcgacatgtcggtgacgaccatgcgcgggtccatctcgcgggcggcgctggccagcgagcgcgacaggcgttgcaacgggaacagcgtggggctggggaatgccgagccgaaggggatcgtgctcggatctttgatcgaatcgagtaccgagaacaccagttcgctgacgtcgacttcggtggagtcgttgacgtggctgctgataaccggctcggaaaacgggctcggcgcgtgagtgttgacgaagtagccggagcgcggccgcgcgcggatcaggccgcggcgttcgagcaggtagtaggcctggaacaccgtggacgggctgactccgtaggtctggctggcgtaacgcaccgaaggcacgcgctggccggggccgaggacgccggagcggatcagttcagcgatgtcgtcggcgaatttttcgtagcgtttcatcgaggagccttggtgctggttgatgatgaggtgtgtcaggagaactgcccctcaccctagccctctcccagagggagaggggactgattgggggatgcttgctaaatacaccgacctgaaagtgctttgctgaatccacaatcgactcggcctgaaagtgctttgctgaatccgtaatcgactcagtctgtcaggtcgatggatagcgacagacacctcggtcggctccctctacccctgggagagggctggggtgagggagcggattctaagggatcaacgattcatcggcgcaacaaacctgctcttcgccacgctgtaaatctcaggctcatcgctgtcggcaattttgaaactcaaggtttgcgagctgctggccgggcgctccgtggtcatcgccaccgacaccggcacgtcgacaatttcccccggcgccaggctcagctcggtcttgccttgcaactggaagccatcgccatccaccagcgtcaggttgtagtcctggcgttgctgggtcttgttgatgactttgaggctatagatgttttcgatctggccttgaccgttctcgcggaacaacccgcgatccttggtcacgtccagcgagaccattggccgctcgaccagcgccaatgccaacgcgccgatcatcgctaccagcaccacggtgtagccaatcagacgcggacgcagcagatgggttttacccccctgcaattcgcgctcggaactgtagcggatcaagccgcgcgggtagttcattttgtccatgatcgagtcgcaagcgtcaatgcacgcggcgcagccgatgcactccatctgcaagccgtcgcgaatgtcgatgccggtcgggcagacctgcacgcacaactggcagtcgatgcaatcacccagacctgcttctaccggtttcacgtcgcgtttgcgcgggccacggttttcgccacgggccacgtcgtaggaaatcgtcagggtgtccttgtcgaacatcacgctctggaaccgcgcatacgggcacatgtgcatgcacaccgcttcacgcaaccagccagcgttgatgtacgtggcggcggcgaagaacagcacccagaacaggctgaccccgccgatctgcaaagtcagcagctcttcagccagtggccggatcggggtgaagtaaccgacgaaggtcaggccagtcatcacgctgatcgccagccacagcgtgtgcttggccgcacgccgggccagtttgttcaggctccacggtgcggcttgcagcttgatccgctggttgcgttcgccttcggtgattttctcgcaccacatgaaaatccacgtccacgaactctgcggacaggtgtaaccgcaccagacccgaccggcgaacacagtgatggcgaacaggccgaacgcggcgatgatcagcagcgccgacagcaggatgaaatcctgcggccagaacgtcgcgccgaagatgtggaatttgctttcagaaagatcccagagcactgcctgacgtccgccccaattcagccacaccgtgccgaaaaacagcacaaacagaaatcccgcgccactcatgcgcagggtgcggaacagaccggtgaagctgcgggtgtggatctggttgtcactggacttggccgtcgccttcattgggcgtgcgggcacacttttaatggttggcgttgcttctacggttcggacggggatttgttcgctcatggttattcgctcatcagcctccatcaggccagagcactatgagcgtcgatctgtttgcataacagactcaggtatttcaataaaaagcggatcagatgggttttcgcgcagcgcctgcgacaacttgaagcagcccgcagacaaaggcgcaaacgcctatcgcagacgtttgcgcggggttttgatcagggtcagtcaaatcaccgaatcactctcgtcggccttcaagtgcttgcgaccgtctttggcgcctgcgacggtcaaggcgtcagcttctttttcgctgatgtaaacgcgccggccttctatttccacgaacgacatggatttttcgctatccgtcatgacttccagggtgtcgcaaatgcgaatttcctcgccatgttcaacggtgaaaaaacacactttttgttcggggttggattcatcgactcgaagaggcatgggagcagtccttttttcagtgaggtctgcaaggttagggcgcacgctgcgccgatcgttctgcgcaactgattaatggtcgccgctgtccatcctttatagacccttggaaaggactgccggatgaacgcgtggtggcatgaagtgtgggaaaccctgcaagcggaattcgctgacgtcggcgatgcctcgcaactgacgcggattaccgtgcgcctgctgatggcggcgattctgggtggcattctcgggttcgagcgcgaacacaaaggcaaggctgccggggtgcgcacacatatgctggtggcgctcggcgcggcgttgtttgtgctggtgccgcagacttcgggggcagagtcggatgcgatgagccgggtggtgcaaggggtgattgccgggatcggctttctcggtgccgggaccatcctgaaaaacaaggaaggcgatgaaggtcatgtcaaaggcctgaccacggctgccgggctgtggatgaccgctgcgatcggtgttgcggctgggttgggcaaggaagcaacggcgttgctcagcacctttctggcgctggcaatttttagcgtgatgccgcggatcgtgaagctgttcgaaaaagaagaagagaagactgatgaccactgatcattccggcgccggagatcgttgatcgttcccacgctccgcgtgggaatgcagcccgggacgctccgcgtcccaaagaatcagtaccagtacgtgccgaatccgacggggtgggtggatccgttggggttgagttccaattgtccgccgccgaacaggccgggttgtgaggttcccggtgggattgctggggctaaggttgatgagggggagccagcgctgccaaagatgacggcgcaggagcggagggcgcggattgatgagttggcggaggctaatgcaaagcaacgtgtgagtgaatatgaaaaactttatgacatgcacactgtgaaaaagcatggttcggaaatttctgatccagctctcaagcagcgagcgatcaatggcgcggaccctcataccggcgatgtcccgaaaggtgccaaaggtaatctaagctctcagtttcatagttggcgcatgcatttgggggccttgaataaagcgatgacgaaggataaaaacggattgattaggcatacagggaaggatcagaagaaaaatccaatagtcaggttggaactgcctggggctgggcgcggttacagacccaataaaaaagataagcaaaacccggggcttaatgaggatatgaattggtttgaggtgaaattcgataaagtgaatacacaggagcctttcacagggttccctgcggaggggaaatgatgctgaaagacccatttttaaatgagcgttttgagcctgacttaatttggtttgttggggtatttgatgtttatgatagagaggagtctaagggtgtagaactcgaggcttatgatccgaacgataaagctgataggagtatgctaataagaaaatattgcttgaatcagccttatttctcacatagacataaacttgtactcattgaaaatctagaggcggcgcttaaggatccaagcttcgattttcaagttatattcgaaatagatgagtgcgaggcaaacagttggccgcgcgaggaatggtattcattagaaagtccacgctgtttttttcaagatgtctttaaattggcgaaagaagtttggaaagaggacctgttgatggcagagagtgaggataagtcggcttggtagactaaaaatcaagtcatcgttacccaatcagctgcgatgagtgaagctcaggcgcagtaagactatcaatcacatgcacgctataccccggaacattcttcgcatgatgcttcgcctgcgatgccatttcagcgagctgactggcatccagttgtgcgcaggcctcggggtgtagatgcacgacgccaatggacagcgacaacagcgcaaactcctggcgcaccccttggcgattcggggcgatgaagcagcccgcgtcgaggtgttcagtgcgatagaaccgtcggcattggctctggaaatcgtcgagcaattggttgaggcgtttgcgccagtcttcggggccgaggaccaggagaaagtcgtcgccaccaatgtggccaacgaagtcgcgggtagggtctacgcgttcgttgagacagtgcgccagacacagcaacacttcatcgccgcgaccgtagccgtagatgtcgttgaagggtttgaagctgtcgatgtcgacgtagcagatgaccgactcgcggccttgttgcagcaaccgcgtcaggcattgctgaatcggcacattgcccggcaacaaggtcagcgggttggcgtagcgagcctgctggattttcagttcggtaatcagtttgagcacatcgatcacccggccgaggccgaggtagctgccgttgagggtgatgatgaagtcttcttcgatgcgttgtcgggcgcggctggtgatcaggcggctgacttgttgcagcgactggctcatttccacggcgaggaagtcgtcgttcatcaggcggctgatcggtttgcgtgcgaacaggtcggtggcgaagggtttgagcagtgcgtcggacaacgaatggcggtggacgatgccacagggctggccttgttcgtcgagcaccgccagtgagttgaggttggcctgacgacggaaggcttcgagcacggtggcggtcggtgtatcgcgatggaccgccggttggtcgttgagcaaggcgctgaggtcgctgccttcgtcgttgagcgccaccgcgctgctgtcatgtttcggcatcaaggcgcgggcatcgcgcggtggatgctcttgtggacggccgagcagataaccttgcaccaggtcgacgcccatttccgtcagtacggcgagttcttctggcagttcgatgccttcagcgatgacttgtgcgcgagaggctttggcgatttgcaggatcgagccgacgaattcgcgcttcaatgcgtcctgatgaataccgtcgatgaagtgtcggtcgatcttcacgtaatccggacgaagctccgaccacagtcgcaggctcgaatagccagcgccaagatcatccagcgcaatcgaaaatcccatcgcccgatagtgatgcagcgcggtttgcagtaactggaagtcgtcgattggcgtttgttccgtcagttcgataacgacctgactgggtggaatgccgaagtcctgcagcagttgcagcgtgcgtcccggttgatgggcggcttcgagcaaagattcgggcgagacgttgagaaacagcttgcccggcagttgctgttcgttaaaacgacggcaggcgctttgccggcaggcgatttccagttcattcaagcgcccggattgtcgcgcaacagcaaacaacgcaatcggtgagtgaagagggctgttggaaggtccgcgtgtcagggcttcgtaaccgagaatacgtcgctccgagaggctgatgatcggctggaacaggctgtgcaatccgctttgagtcaggatcgagctcaaggcactcagctgttcggtcgtggtcatggcaatctctggcgataaaaaaaggactgggagcgctctcgttgaagagagtggctcccagtcctttattgcacgacagaatgatgactgtttgatgacgatccggggatcgtcagcattaaattgccatcacttacttcttggccacctgattgctcagcttcaggtaatccagcagcacgcgcccggtttcgctcaggtaggcatcgtcttccggtttgaccttgtccggctcggcggcggagagggcgtcgtcgtcttctttcttcagctccttgagcggctcttcgcctttggccttgcgacggatgttttccatcgtcagctgtttggcgtcgatgtcggcgtgctgggcacgacgatcggcttcgttgaggctgacggttttttcttccatcagtttctgcgccagggccagcttgtcgcggatgaacacgaactcggcatccttggcggtgcgggtgtcatgttcggacttgagctgggctaggaacggtttgaacggatcggccgccggtttgattgccgcgcggatggtgtcccacggcatggcttccggcagtgcgctctcaccgatttccttggtatcgatcagcgacggatagtcgatgtccggcagcacgccctgatgctgggtgctctgaccggacacccggtagaacttggccagggtcagtttcagttcgccatggttcaacggctgaatggtctgcacggtgcctttgccgaaggtctggccgccgatgatcagcgcgcggtggtagtcctgcatcgcgccggcgaagatctccgaagccgaggcggacaagcggttgaccaacagtgccatcgggcctttgtagaacgcgcccgggttctcatcttccagcacgtcgacacggccatcggcattacgcacgaggacggtcgggcccttgtcgatgaacaggctggtcagctcggtggcttcctgcagggaaccgccgccgttgttgcgcaggtcgatgaccacgccgtcgactttgtctttctgcagctcggtcaacagctttttgacgtcgcgggtggtgctcttgtagtccggatcgccggcacggaacgccttgaagtcgaggtagaaggccgggatctcgatgacgccgagcttgtagtccttgccgtcctgtttcaggttaagaaccgacttcttcacggcctggtcttcgagcttcaccgcttcacgggtgatcggcacgatcttggtggtctggtcgttcggcgcattgctggccggaatcacttccaggcgcaccacggtgcctttcggaccgcgaatcagcttgaccacttcgtccagacgccagccgaccacgtcgaccatctctttgttgccttgggcaacgccgatgatcttgtcggccggggcgacttgtttggttttgtcggccgggcctgccggcaccagacgcacgactttcacctggtcgttgtcgctctgcaacacggcaccgatgccctcgagggacaggctcatgttgatgtcgaagttttccgcgttatccggcgacagatagttggtgtgcggatcgtaagacatggcgaaggtgttgatgtacgcctggaagatgtcttccggacgggtctgatccaggcgcgccaactggttcttgtagcgcttggtcagggtttcctgaatctgcttcggctctttgccggcgatcttctgacgcaggacttcgtccttgacgcgtttgcgccacaggtcatcaagctctgccgtggatttcagccaaggggcgtccttgcgatcgatcagcaaggtttccctggtggtgaagtccatcttgtcgacgcccttgttcagctccgcaatggcgaagtccagacgcgccttgacgcggtccaggtagcgcttgtagatggtgaacccggcgttgagatcgccgcttttgaggaagtcgtcgaactgggtcttccacttgtcgaattcggcgatgtcgctggccatgaaatagctgcgcgacggatccagcagcttgatgtagctgtcgtagatgatcaccgagcgcgcatcgtcgagcggcggcttgctgtagtggtgacgcttgagcaattcgacgacgttcaggctggcgatgacttcatcgcgatcaggctgcaacttgtcccagctgttggctgcgaatgtactgcccgacaccggcaacaggccgataccgatgaaaagagcgagggcggtgctggggagcaaatgcttcatgctgattcgacgcggggacaattgataacgcatattaggccgtctttgaagtcgccggtctacgagagccggtcgcataatgcaaaaagcccggcgctacagcttcgggctcagtccagactcactatggaggcactgtgaaggcattgcaaggcgttgaaggtcaagtggcatgggttgaggagccgagtcctacgtgtgatgtaggacaagtccgcattcgagtggcggcagccggcctaaatcgcgccgatttattacagaaagcggggctctatccgccaccgccgggggccagccaagtgctcggtcttgagtgctccggggtcatcagtgaggtcggtgcgggcagttcgtggcaggtcggcgatcgcgtttgcgccttgctggccgggggcggcatggccgaagaggtggtggtcgacgggcggcatgtgctgccggtgcccgaaggcgtttcgctgatcgaggcggcggcattgcccgaggtttacgcaacagtctggttgaatgtgtttcaacttgcggcgctcaaaccgggtgagaaagttctcttgcacgccggggcgagtgggatcggttcagccgccattcagttgtgcaaggcgtttggcaatccttgctgggtcagcgtcggttcagccgagcgtttggcgtattgcgaggcgctgggcgcgcagggcggggtggtgcgcaccgatgatctggagagcctgcgtgatttcgggccgttcgatgtgatcctcgatccggtgggtggtaattattcggcgctcaatctgaaactgatcgcgctggacgggcgttgggtgttgattggtttgatgggcggccgtgaggcgaagctggacctggcgcaggtgttaggcaagcgcgtgcaattgctcggctcgaccttgcgcagccgtgacgatcaattcaaggcggatctgttgagtgatctgggccagcacgtgtggccgttgtttgccgaagggcgattgcgtccgcagttggccaaagcgtttgcggtgaaggatgccgaggcggcgtttgcagaactggcgagcaacactgttgctggaaaactggttttggtgatcgacgacagtctgagctgagaacagggaaaaagcccctcaccctaaccctctcccaaagggagaggggactgaccgggttgttctgtcgggctacatcgacctgatgcatcgggtcgaactcaggtttggaatatcagcctgcctgtgcagattaaatctttgtcatttccagaggtggattggccagccggctttttcggcgtgctccagcagcactgggtccgggttgaccacgtgcggaaaatccaccttcagcaacaacggcagatcattgcgtgagtcggaatagaaactcgcgccttcgagattctcttcttcggcatccagccactccagcaaccgggtgatcttgccttcgcggtaggtcagggtgccgacggtgtggccgctgtacacgccatgggcgacttccagttcgatgccgagaatctcatcgatacccaagcgatcggcaatcggttttaccaagtgtgtgcccgacgccgaaatcaccagaatgcggtcgccggccttgcggtgggcagcgatggttttggtggcgtcgctgaagatgatcggttcgatgaagtcttcaacccatggcccgaccaggtgctcgacttcttccggcgtacgcccgatcaacggctccaggctgaattccatgtagtcttccatgcgcaatttgccatggctgtaggcgtccatcagttcgttgttcttgcgcatgaacgattcaggatcgacccagcccaggcgccccatctgctcgctccagagggtggcgcagtcgccgtggatcaacgtttcgtccagatcaaaaattgccagagccatcagtgcagttctctcttcaacgtcagcaaagtcatcaggctacctcacacagggccgtcggatcgatggaaagcgccagacgctgaccgtcgggatgcagatcggcggccgagcggttgagcacatccaccaccagttctacgccacgcgcttcgatccggtaacggatgacgttgccaagaaggctgtggctgcggatctgcgcgtcgagttcgccgttgaggctcagttcgatggcttccgggcgaatggcgatgcggtgattgatcgggcgctgcaacagtttcgaagcggcttgcgcgtcgagcaggttgtagttgccgatgaagccggcggcgaacacatcgacgggggcggtgtagagggtttcggcatcgccgctttgtacgatttttccctgattcatcaggaaaatccggtcagacatggtcagcgcttcctcctgatcgtgggtgacaaaaatcgtcgtcaggccgagttcgcgttgaatttggcggatctgttcgcgcaggtgtttacgaatccgtgcgtcgagcgccgacagcggctcgtccagcagcaacaagcgcggacgcgtgaccagcgaacgggcgagggcaacccgctggcattgaccaccggataactgatgcggatagcggctggcgaagtcgttcagttcaaccagtttcaacacctcggaaacgcgtttgtggctgtcgtcggcattgaccttttgcatgcgcaaaccgaacgcaacgttttgttcgacagtcatgttggggaacagcgcataactctgaaacaccatgccgatcccgcgcttctgcgggctcaacggcacgatatcgacgccatcgaggaggatcttgccgccatcgactggcgtcaggccggcgatgcaacgcagcagggtggattttccgcaaccggacgggccgagcagggtgacgaattcgcctttgttgatttcgcagtcgatgtcgctgaacaccgtggtgccggcgtagcttttctgcaggtgttggacgctgacatagctcattcgcttttgtccttgttcaagatgttggcgatccaggtcaggaccagcacgaaaaagaaatacgagatgaccagggcactggtgaagtggccgctgctgttgcgcatgttgttcaggtaaacctgcagggtttcgtaacgcgtgccgacgaggatgttggcaaagacgaactccccgaagaggaacgagaacgacagcagcaacgcgaccatcaggcctttgcgcaggttgggcagcaccaccagaaacgccgcctgaaaggtgctggcgccgagcagctgcgcagcgtccatcaggtcgcgcaggttgatcgcttgcaggttgttggtgatcgcccggtacatgaacggcagcgccacggtgaagtaacaaccgatcagaatccacggggtgccaaccatcgccattggcccggaaccgtagagctgcagcaggcccaccgatgacaccaccggcggcaccgcgaagggcagcagaatcaggatattcatcagcgcatcgagtttcggaaagtggtaatgcaccacgaacagcagcggcagaatcaacaccaccgaaagcaccagtgcgccgacacacacaatcaatgattggccgaaagcgtgaaggaagcgcgggtcgctccacagctggatgtaccacttgaaggtgaagccgctgggcagaatggtcgccgaccaactgctggcaatcgaatagaccagggtgcccaccagtggcagcaagaggatggcgaacagcagataaaccacgacgcggtggtagaggccggccgggccggattcagcgcgagacatggtagctcctcttcaacagcagttgatgcacgacggtgacgatggtcatcagcgccaccagcaccacggccagagcgctggccaggttcggatcgagggaaatatcgcccgagaccatcgccgcgatacgaatcggcaggacgttgaagttgcccgtcgtcagcgcatacaccgtggcgtaggcgccgagggcgttggccagcagaataacgaacgtacccagcagcgctggtgtcagcaccggcaaaccgatgtgccgccagaactgccagccgttggcgccgagtaatgcggcggactcgcgccagtcttcacgcaatgcgtcgaaggcggggtagagcaacaacacgccaaggggaatctggaagtaggtgtagaggatgatcagcccggttttcgagtacagattgaagtcctgaatgatccccgactgcttcagcatgatggtgatgctgccgttgaacccgagcaggatgatgaacgcaaatgccaggggcacaccggcgaagttgctggtcatgttggcgaaggcgttgacgaagttgcgcagcttcgaatcgacccggcgcagggaatacgcaccgagtacggcaatgatgatgccgaatacactcgaccagaaactgatctcgaggctgtactggatcgcctgcaaatagaacttcgagctgaagatcttgctgaagttggccaagccccaaccgaactcttccgattgcaggctgttgatcatcacccagaccagcggggcgatttcgaagacgataaagaacagcgtgaacggcaccaggcacaacgccgccagccatttgccgcgagtcattgagttcacttgagcagctcccggcacacaggtttgtcgtggggtacgccgagcaattcgcagaccgtgccgcagatgtcggtctgcttcggtgcggcgccagcatcaaggctgaacgcatcgccgaggacgaacagcggcacctggcgctcttccggcagcaagccgttgtgcgagcggtcgttgttcatgccgtggtcggcggtcaccagtacttggaagccggcttcgagccagttctgcaaatagtcggcgaggatgatgtccgccgaacgcgcgctgttgcggtactgcgacgaatcgaggccgtgcttgtgcccggcgtcgtcaatgttcatcgggtggatcagcaggaagtccggatcgtggcgcaggcgcaggttttcggcgtcggcgaacaggtgcgaatccgggtagtgatcgttccagtagaaatgcccgtgctggatcggcagcgacaggttgtcggtgtgccggtcgcgggcagccacgaacggtgagcggttgtacaactcgctgacccagtgatacgccgctgcagcggttttcagaccggcctcgcgggcgtagtggtaaatgctgcgctggttggacaggcgcgagacgttgttgtggacgatgccgctgtcgatcggcggcacaccggtgaggatgcattcataaagcggtcgggacagggccggcagctcgcactccaactgatagagcgcggcgcgtcctgcgccaacataagcctgcagatgccccatggcgtgacgcgcgacctcgtagttgaggccgtcgagcacgacaaggatgacgttgtgcttcataggggcaaaaactccgcgaaacaggaaatttcagattcacctggatcccttgtaggagtgagcctgctcgcgatagcgattgaacattcaacgacaatgttgactgaactaccgctatcgcgagcaggctcactcctacatggggatttgtttcggatcacaaaaatggtgatcagccgcttatttcatctcgacgatgacttcttcgttccacgcctgtggcagggctttcgaagtcttttcccacgcgtcggcatctttgatcggggtgactttcttgtactgctcgtttggcagcagtttggccttcacgtcttccggcagttgcaggtgctcggcgcggatcgggcgggcgttgccgcgcgcgagattggtctggccggcgtcgctgaagatgtattcgcgagtcagcttggcggcgttaggattttttgcgtatttgttgatgatcgtggtgtagccggaaatcaccgaaccgtcggacgggatgagcacgacgtagtcatccgggttggccatcttggccttgtagctcaggccgttgaagtcccagaccacgccgacttcgatctcgcctttttccatggtggcgatggtcgggttggccatcgacaggcgaccttgcctggcaatgtcggcaaacagcagcagcgcaggtttgatgtttttctcgtcgccaccgttggccagtgccgcagcgagaacgccgttggccgcttgtgcggcggtgctcacgtcaccgatcgagactttgtatttaccgcccttgaggtcagcccatttggtgggtacttcggagccgtgcagcagttttttgttgacgatgaacgcgatggtaccggtgtaggccagtgcccagttgccgtccttgtccttggcccagtccgggacttgatcccaggtgcttggcttgtacggctgcaccacgccttgcttgaccgcgatcgggccgaaggcggcaccgacgtcgccgatgtcggcggtagcgttgtctttctcggcggcgaacttggcgatttcctgggccgagctcatgtcggtgtcgatgtgtttcaggccgtaggtcttggccaggtcttcccaggtgcctttccagttggcccagtcatccggcatgccgacgctgttgacggcgccttccgctttcgcagcggcttcgagggttttcagatcggtgccggccgccatggcggaggtgcacattgcaatggtcgagcctaacagtgttgccaggaaaagctgtttcattccgaagctccttggtcgtgttcaacgctgcgattgcggtgtgggttggtctaggtcagcaatacctgagccaatttaggcgggctggatgacactttaatgtcggtggccctgcggcaagtcttttgtgtgcctggtatcggcggttgccagataagcgtagaccatgctcaggccccagcggacaagggacttggccgatgtattgcaagtcatgaggacgaccgttcggtagttttgtcatctcccggtcatctgcactgcctaggcttgcacacacggaaacggttcgttggccgtgggttttttgccccgaaacagtgctggtctagtccagataggtaacttgatgcgtgatgaggcaacaaaagcggtgacagccattggccaagtgctgcaggaacagctcgatcatggtctgttggcggcgggcagcaagttgccggccgagcgcaggctcagtgagttgttcggcacgacgcggattaccgtgcgcgaggcgttgttgcaactggaagcgcaggggcagatttatcgcgaagaacggcgcggctggttcgtgtcgccgccgcgtctggcctacaacctgatgcagcgcagtcattttcacgcaatggtcagtgcgcaggggcgggtgccgtcgaccgaggtgatttcggcgcggctgcagccggcctcggcggcggtgtgtgcgtggttgcagctgccggcgttgtcgagcgtgattcagatttgccggtcgcggcgcattgatgggcgtttggtgttgtatgtggagcattatttgaatccgcagttttttccggggatttttgagtttgatttgaatcagtcgatgaccgagttgtatgcgcgacattacgatttgcactatgggcgggtgcggttcgagattgtgcctacgtcgttgtcggtggatgcggcggcggctttacgggtttctgtggggagtccggggttgcggattgctcgggtcaattatgatcagcatgagcggttgattgattgtgatctggagttttggcggcatgatgcgattcacgtatcggttgatgtggtttgatcgttttgggggcatatccgttgcttcgggtgttgctgattagggttccgcccttacggcgggtaactttttccagacgcccggaatgccggcccagaaaaaagtaacccaaaaggcttgctcctacgtgcggcccgctcgctggggctcggggttccttcgctccgggatcgatccgggcgcagcgcctacggtttgcttcgctgcacctcctctcgctgtgtttggctgcgccaaacggtcgctgcgctcccacccccggatcaacccctccactcagccttccgacgtcgcccgtggatcaagatcaaaagcggtactcgagcttgcgctcattgtgttgagtggtgagaagcagaagcgatattggtttgccggttggactcaatccttgtgagagctggcttgccagcgatggcggcctgacagccgacctgtttcctgcggatgtactcgatcccttgtaggagtgagcctgctcgcgatggcggcctgacagccgacctgtttcctgcggatgtactcgatcccttgtaggagtgagcctgctcgcgatggcggcctgacagccgacctgtttcctgcggatgtactcgatcccttgtaggagtgagcctgctcgcgatggcggcctgacagccgacctgtttctgacaggctgcacacgatccaaatgtgggagcgagcctgctcgcgaaagcgcccccacagtcacctcatctctacttgcctgcccgcgcattggcatacaaataatccgtcgccaacgacgccaatgtcctcacgcccaccaccagcgccgattcatcgacaaagaatcctggattatgattcggcgcggctttgctcatgtcttgatcccgcggcgtcacgccgagaaacacaaacagtcccggtacttccttggcaaaaaacgagaagtcttccgcgccccccaccagcggtgcattcaccacatcatccttcgccgcccacttcaaagtcggcagcattttttcggtgagcgccgggttgttgatggtcgggtcgtatttttcgatgatggtgacgtcagctttcgcgccgccactttcggcgattttctccacggtctggcgtacatcggcatgcagtttctggcggataccgtagtcgtaggagcggatcgttccgctcatgtcgacggattcgggaatgatgttgtagcgggtgccaccgttgatggtgccgatgctgaccactgacggataagacgagatgtcggtgcggcggctgaccactgtttgcaggccgacgatggtttgtgcgccgacggtgatcgggtcgatgccgtcccaggggcggccggcgtgggtttgcttgccgaggattttgatgcgcaggtcgtcggagctggccagggtcgcgccggggcggtaggcgatctggccggcggggacgccggcccagacgtgcaggccgaagaccgcgtccggtttgggtgatttcatcacgccttcctcgaccatcattttcgcgccccaggtgtttttgccgtcggggatgaagtcgctcgggccttcttcggcgggctggaagtagaacaccacggtgccgggtaatgtgtcgcgcatgcctgtgagaattttcgccgtgctgagcaggattgcggtgtgggcgtcgtggccgcaggcgtgcatgacgtcgacttctttgtcgaggtagatgcctttggctttcgaggcgaacggcaggtcggcgacctccttgaccggcagcgcatccatgtcggcgcgcagggccacggtaggaccgggcagggcgcctttgagaacggcgaccacgccggtgcgggcgacgccggttttcacttccaggcccatggccgtgagttgtttggcgaccagttccgcagtgcgtttttccgtgttgccgagttccgggtgggcgtggatgtcgcggcgggtttccagcagttgcggttcaagcttttgcgcttgttcgccgatttcagcgcgggtgctgtccatcgtcgcggcgccggcgtggctggcgaccagggtgagcaaaacggtctgggcaatgcgcgtcagttgcatcgggtttctccttgattattgttgtcgggcttccctgcctgtgactgcaaccgcgcgcctgagtgcctattccttcggttcgccaccgccggcagtgatcacttgcacgctcatgcgcggcgttgccagatcgagtccagcctcgtcgaggtggcgtttgagtgacaggttgaaggctcgggacacttcccattgtttgatcggcgcggtcttgaatcgcgcgcgcagaatcgcgctgccggattcgaaactttcgaccccctgaatctccagcggcgaccagatgttgcgtcgctgcaacggatcggtacgcatcttctgcccgacttcgcgcatcagtttgatcgcgtcgtcgatttccatgttgtacggcaccgcgacgcggaagatcgcgtagccgaactcccgcgagtagttcttgatgcttttgatttcgctgaacgggatggtgtgaacgatgccgtcgatgtcgcgcagacgcacggtgcggatggtcaggccttcgacggtgccgaggtggccgccgacgtcgacgtagtcatcgatggccagcgagtcttcgatgatgatgaacaggccggtgatcaagtcggcaaccagcgactgcgcaccgaaaccgatggccagaccgattacaccggcaccggccagcaatggcgtgacgttcatgcccatgttcgccagtgcgacgatcagcgcgatgatgaaaatcgccacgaacagcacgttgcggatcagcggcatcatcgtttgcgcgcgggcgttggccaggcctttacgcgagcgggtgagggcgtggtgcacggcggtgtcggcgagaatccagatcagccaggaaaaaatcaacgtaccggccaggctgaacagtttgacgctgacgtcatgcccatcgccttcggcgaaaccgatcaacgatttgccccagacgcgcaggcccagctcgatgaatgccagccacaccagcagatgcgcgagggtgtagaagaagtttttcaggcgctccgagtacaaggcgtgacgtctcgccccgcgttgcggtttcagtgaatggcgacgcacgaggccgttgatcaccatgcacaacaccagcagcacggtgcagatcagcgactggcgcaaggcggtgctggtgtcgccggcggagacaaaagttgcgaacagcgagatgccgaccagcaccagcgccggcacgtaccagaacgttccgaggatttcgatggtgtcgctgagggcgcggcgggtcaggcgtcgggacagcggctggttgcggatcaggtgcgcaatcgggcggcggaaacgcaggataaacagaccggtagagagtgccgcgaggacattggcgatagtggcggcggagtgcgccaggtgcacgccgaggctttcgatcaggcgtgggtcgttcagcgcttcaccaaacgcggcgaagctgccgatcagccacagcggtcgaaatgcctgatgacgcaggatatacagcgcgcgatggcggtgcgggccatcgagcagggaaaacgcgatcacgcagatcgccgagaaacacgttccgaccaccagtgcgtaggccagtaccatcgccaggcttttgcccagcgaagatggcaaggcgtaggacatgtaaacggtcatcaccagcgcgatcaaccatggcccgagcttgcgcaaagcgaagcgcagcatgtcgagggctttggggtgttgtggcagctcttcggtcaggccgaagcgcatgcgcactcgatggccgagccagatcagggcggcggcgagcaggctccacaccgcgaggatcatggcgaaaccgaagatgatcggcagccattcgttagccggcagcatcatgccgctgagttcctccttggccaggtcgaactcgttggaccaacgggtaatcgggctgtcggcaccggaaaactgtttttcgaaattggccagggtgccgccgatcaggccgagcacgccttcttccggtgtggtctgggcttttttcgtagcgtcgcgcagctttttcagatcggtcagcaactgtgcgcgttgcttgtcgttttccagcgacttgatgacttcgtcgagggactggccgagcggttcctgggcttcgggctgcgccttgttggtgttgagcagaccgggcaaaccgaccgcatgggcgggcgccagcggcagcagcgtcatcaggcagacgaggaacagactgggcaaagcaaaaagacgagcgaacactaggcggtcaacctcgcaaggggcggattcgctggagtgtacgaggccaaccccgtcaatgcgagccgggcgcggatttattcgttgagtttggcgaggatcttgtacaccacggtggcgaggatcgtgagcatgccgatccacatggcgaacacaccggcgttcttgtcgcggaagttgaagccgatggccagcaggatcattccgctcagaatcggaatgagcatggcgtgaaacgaagacatcgagatcatggggactgccttgtcgaaatgaatgatgtaagtctaggtcggtttctgccggccggtattgatctgagtaggagttgccgcaggctgcgatcttttgattttgttttcaagatcaaaagatcgcagccttcggcagctcctacagcgaacaagtggtcccgaatggttaaggcaactcgcggcaggcgtagaacgcgctcagcactttgaccagatgtgccaggtcatggctgccgcacagttcgcggatcgagtgcatggcgaaggtcggcaggccgatgtcaacggtgcgcacaccgaggtggctggcggtgatcgggccgatggtcgagccacagcccatgtcgctgcgcaccacgaaactttgcaccgggacttcttcggccatgcacagatggcggaagaagccggcggtttcgctgttggtggcgtagcgttggttgctgttgacctttatcaccgggccggcattgagtttcgggccgtggttggcgtcgtgcttttctgcatagttggggtgcacgccgtgggcgttgtcggccgagaccagcagggacttctggatggtgcggacgaattcatcaccttccggcagcaggcggcgcagggtttgttcgagcatcgggccgtcggcaccgcaagccgagcaggagccgacttcttcgtggtcgttgcacaccagcacgcaggtttcgtcggtttcggcagtcagcaatgcttgcagaccggcgtagcacgacagcaggttgtcgaggcgcgcgccagcaatgaagtcgccattcaaaccgatgacggcggcactttgcgtatcgtagaaactcaactcgtaatcaagcacgacgtcggcattcaagccgtgttcgcgggccagttgatcggtgagtacggcacggaaatcgacgcgctcgtcaccggcaaattgcgcgaggatcggcggcagttcggtctgcgcattgatcgcccagccttgattggcttcacggttaaggtgaatggccaggttgggaatgatcgcgatcggtgccttgaagtcgatcaactggctctcgaccttgccgtcgcggcggaaggtcacgcggccggccagcgacagatcgcggtcgaaccacggtgccagcagcgcgccgccgtagacttcaacgcccagttgccagaagccttgacgctgcagttccggttgcggcttgacccgcaggcacgggctgtcggtgtgcgcgccgaccaggcggataccgccgtgcaggggcgaagtgcggcccattttgatcgcgacaatcgaggagtcgttgcgggtgacgtaatagcggccgttcggctcggtggtccatggctcacgttcgtcgaggcgcacgaaaccggcagcctccagacgctgaacaagactggcggtggcgtggaacggggtaggggaggccttgaggaagtcgatcaggccttggttcaactcttcgcgcataagaaactccagacagcaatgggcgggagtttaacgcatcggccggggaattgaatctgcaccggacctctgtaggagtgagcctgctcgcgatagcggtatgtcagacaagacttacttgaatgacacaccgctatcgcgagcaggctcactcctacaaggggtctgcagtggcggtcagaacggcgcggggcactcgaaacgcaggcgttcgccggtttgcgggtgggtgaagctgagcatgctcgcgtgcaggcacagccgtggccaggctgcgagggcttgttcatgggcatagagcccgtcacccagcagcggatgcccgatcgacagcatgtgcacgcgtaactggtgcgaacgcccggtgatcggggtcagctcgacgcggcaccagtcgccgcaacgttcgagcacgcgccagaaggtcagcgcatgtttgccgaattcgtgatcgaccacgtgacgcggtttggtcggcggatcgtagcgcaggggcaagtcgatgctgccgctgtccagttccggttgaccccaagccagggcagtgtaggccttctctgtttcacggtcgtgaaactggcgcgacagttcgcggtgagtgtcggcgtcacgcgcgagcagaatgataccggaggtttcccagtccaggcgatggacgatgcgcgcttccgggtagccgttttcctgcaagcgggtaatcaggcaatccttgttgtcgtcggcgcgaccgggcaccgagagcagcaacgtcggtttgtcgaccaccagtacggcggcgtcctgatggatgatgcggatgttggacaacggcattaaaacagcctcgtaacaaatgccaacggcggctcggaactgctgataaccctgtaggagctgccgaaggctgcgatcttttgacgttgaagatcaaaagatcgcagccttcggcagctcctacacaagcatcaatagtccgagccgccgtagcgactgccaaatcgactcagcgatcaggcagggtgatgttgagttccagaatcgagcaactgccctggctttccagtgcaacatgtacgtcgtcgttgccgatgttgacgtacttgcggatcacgtcgaccagttccttctgcaaggctggcaagtaatccggcgtgctgcgctggccgcgctcatgcgccacgatgatctgtagacgctctttcgctaccgaggcggtacttggctttttgttggcacgaaagaagtcaaaaaggttcattacctacctccaaacaggcgctcgaagaatcccttcttctcgacatcgaggaaacggtgggctttttctttgcccagcaagcggtcgacggtatcgctgtaagcctgaccggcatcgctctggtcgtcgagaatcaccgggacgccctggttggatgccttgagcaccgcctgggattccgggatcacgccgagcagggtgaccgagaggatttccttgacgtcttcaacgcccagcatctcgcctttttcaacacgctctggatggtagcgggtgatcaacaggtgttccttgatcgggtcttcgccacgttcggcgcgacgcgatttgctcgccagcaggccgagcatacggtccgaatctcgtaccgaggacacttccgggttggtcacgacgatcgcttcgtcagcgaagtacatggccaggtgcgcacctttctcgatgcctgccggggagtcgcagacgacgaactcgaattgttccttgagctccatcaggactttttccacgccttcgacggtcagcgcgtctttgtcgcgggtctgactggcggccagtacgtagaggttttccaggcgcttgtctttgatcagtgcctgttgcaggttggcttcgccgttgaccacgttgacgaagtcatacaccacgcggcgctcgcaacccatgatcaggtcaaggttacgcaagcccacgtcgaagtcgacgatcactgttttgtggccgcgcagagcgagaccggtaccgatagcggcgctggtggtggtcttacccacaccacccttgccggatgtaaccacgagaatcttggccaaggtgtttcacccctaaggaagaaggactttttagcccctgaaaaacatctcttgaaaactactgcagtcggacagccttggctggaatttggctttaggcctttttcctacttcgtttgagccgttttcgctacgttttagagatgcttggaaaatgcggcagtatccgttaaagccgaatgatgttcaacacgtcgcccgacaggctgacctgtacgcccgagccccacattgggtcgcgacgcaaatcttcggaaaccttgtagtgaccggcgatggagatcagttcagcgctcaattgctgacagaaaatccgtgccttggtatcacccttcacgccggccagcgcccgaccgcgcatcgggccgtatacatggatgttgccatcggcgagaagttccgcccccggactgaccgacgacaccaccaccaaatcgccaccctgggcatatatctgttggccaccacgtactggcgtggtgatgacgcgggtctgtttgacggtcggttcaggcggcttttccggcttctttttgacttcggcttcggccatttccagcggtcgttcgcgggcgccggagggcggcaacaccgggatgtcgatggcgatggcggcggcgatgtcttcaatgcggctggcgcgaatcgccagggtgcgcaggccatgttgacggcacacgcgcatcaggcccggcagatcgacagcgccttcgcccggcggcaatttgtccagcgccagaaccagcggcgcgttgctgaagaaattcggcgcctgcgcaactttggcggccaattgccgatcgaggctgtcgaggtcgttacgggccagttccagcacggtaatggccagcatgctgcccttcaactggaacacgggatcttggtctaacggttcggttttgctcatgtcggcatacaacggcttgtcactaaaagtgccgagacttataacgagaacgcccgcaggccgcaagccgggtcgaacgatgtagaatgcgcggccactgtatttacggaagctttaatggatcgcccgcgttttcgaaaagcatttcttgctccgcgcttctggccgctctggtgcggcttggggcttttatggctgatcgtgcagctgccgtatccggccttgctgaccatcggtcgagttttgggtgcgttgatgtatcgcctcgctggcgaccgacggcgcatcgccaagcgcaatcttgaactgtgcttcccggaaaaatccgccgccgaacgcaaacgcctgctcaaggaaaacttcgcctccaccggtatcgcgttttttgagatggcgatgagctggtggtggtcgcgtgagcgcctggcgaagctggcccatgtggaaggccttgagcatttgcaaaaagcccagcgcgaaggcaaaggcgtgattctgatggcagtgcatttcaccactctggagatcggcgcggcgttgctcggccaacagcacaccatcgacggcatgtaccgcgaacacaaaaacccgttgttcgacttcatccagcgtcagggccgcgagcggcacaatctcgattcgctggcggtggaacgtgacgacgtgcgcggcatgctcaaattgctgcgttccggtcgggcgatctggtacgcgccggatcaggattacggcgccaagcaaagtatcttcgtgccgctgttcggcattcaggccgcgaccgtgaccgcgaccaccaaatttgcccgtttgggtaaagcactggtggtgccgttcacgcaggagcgtctggccgacggcagcggctatcgtctggtcgtgcatccgccgctggaggatttcccgggcgagaccgaagaagctgactgcatccgcatcaaccagtgggtcgaaggcgttttgcgcgattgcccggagcaatatctgtgggcgcatcgacgcttcaagagccggccacccggcgagccgaagctgtacgccaaacgtggttgattgatcgatccccttgagcaccatggagtgttgcgatgagcccagctgaaccggtcacaggtttgattctttccggcggcggggctcgggcggcgtatcaggtgggcgtgctggccgcgattgccgaattgttgccggtgggcgcggacaatccgtttccggtgatcgtcggcacttccgcaggcgcgatcaacgcggtgagcctcgccagcggtgccaccgattttcgcgccgccatcgaacggctgacgctgttctggcagggctttcgcagccaccgggtattgcgcagcgactggtccggcgtcattcaccaggccagtcgttttgtcagccacagcctgctcggtatggggcgacaaatgccggtcgcgttgctcaacagttcgccgctgcgcgaactgctcaatgaaaagctgcacatgcccggcatcgccgaatccatcgcgcgcaagcaattgcacgcagtggcggtgaccgcgttcgggtatgaatcggggcaagcggtgacgttctatcaagggggcggcacgattgattcgtggctgcgccatcggcgcattggcgtgccgacgcaattgtcggtcgatcacttgctggccagttcggcgattccgttgctgttcgcgccggtgaagatcggtgatgaatatttcggtgacggcgcggtgcggcaatcagcgccgatcagtccggcgttgcacctgggcgccagtcgcgtgctggtggtgggtgtcagtggcaacccgcgcggctttgatccgcagcagccgctggagcgcacttacacggggcagcaaccgacactcgcgcagatcggcgggcacatgctcaacagcacgttcattgacagtctggagagcgatatcgagttgctgcagcgtctcaaccagttcagccatctgatgcctgctggcacgccgacccgcgagctgggtgtggcgccggtggacgtcttggtgatttcgccgagtcagccgatcgacgagatcgcggcgcggcatcgtcaggaattgccggcggcgttgcgtttgtttctgcgcggaccgggggcgaccaagaccagtggggcgggggtgttgagttatttgctgttcgaggcggggtattgcagcgagttgattgatctcggacggcgcgatgcgttggccaagcgcgaggagttgtgccggtttttgggattgccattttaaagcaaaagatcgcagcctgcggcagctcctacattggaatgcgctatccctgtaggagctggcgaagcctgcgatctttggatttttatcagaagtggaacttcaccaggaagttggtcacgctctgattggtcttgaaggcaccggtgtcgtcgatgccgtacttgtctttccagtagtcgtactcaacaccgacatacaactgcttctcgccaaaactcagcgccttgcccaggtcgtatttgacctgtgggttgaagtgcaggttggcgtggtaatcgcctttggagttggagtcgttgtcggtcacccagtccatgtaaccgtcgatcaggatgttcgagttgcccacgggaatggtgtaggaccagaccggggtgatctgccagacgttgtcaccggcacgcgaaccttcggtgtggcgctggtagaagttcaactggaagtagtcgaagcccgggatggccaggtcgaagccagggccgatcaggtaggactcggtatcaccttcgccgaactcgtaggtcatcgccagcagaacgtctttgatcgggccgaattcgatcttctggttgagcaccttgcccagcgagatgcgtggctggaactcgccgtaataggtgttcggaccgttgttgaagtccttgtcaccgttgtagaagatcttgtcgatgaagaagaagttgtcgccgtacgtccacgcatcggcgtgttcgaaggtgacggtctgctggatgcgcgggttgacctggaagtccttgccatagaggtaggtcaggctgttgttctgccattgcagcaggccttcggccatggcctggcccccggctaacattgatcccgcaagcatcaggctggtgcacatacgtttcattcggttgctcccaaagtaggtgttccacgtttatttttttaagatcggcgctctggtgtggcgccttttttcgttgctgcaaaagtcatccgattggtcagctttcatgctgttagcaagagctgggccaaggcttttcgaaaagcaaaaaaacgcccgtcggctgctgaaaaacagtcgattgagcgtgttttcgggatgcctcggtactgaccggggccgggataagttggcccgtcggtcaggaattaaatccgggcttttttttagaccgaattcaagaggccgcggagaatactgactcctcggccagctctcaagtgccccgcaacagagcaccgacgacaggtatggagcacggctgcgggccatcttaaaagtgcaccttcaccagcaggctggcggtgttctgattggtgtcgaaattgtgcgtattttcgacaccgtacttgttcttccagtagctgtattcggtgccgacatacaactgcttctggctccagcccagggctttgccgaggtcatatttgatctgtgggttgatgtgcaggttggcgtgataggtgccacgcgcgttctcgtcgttgtcgacgacccagtcgaggtagccgtcgatcagcacatcggaattgcccaggggaaagctgtacgaccagccgggggtgatctgccagacgccgtcgccgggacgcgggccttcggtctggcggcggaaaatgttcagggtgacgtagttgaagccgggcaccttgaggtcgaagccggggccgatcaggtaggcctcactgtcgccttcaccgtattcgtaggtcatggcgagcaagacgtctttgatcgggccgaattcgagcttctggtcgaagatcttgccgaaggagaagcgcggggtgaattcgccgtagaaggcgtgcgggcctttgttcgcatcttctttgccgttgtagaagatcttgtcgacgaacaggaagttgtcgccgtatttccacttgtcggcgtgctcgaaggtgagcgtttgctggatcgacgggttgatcgcgaaattcttgccgtacagatagctgaggctattggtctgccacagcaggagatcgccggccatggcctgactcgcggccagcaggccgccgctcaacaacacattggtttgcgtgcgaatcatctattgctccctcttgtttttattgtttgaggcgcagagctttttttgccctttgtaggagtgagcctgctcgcgatcgcggtgtgacattcaacacatcagttgactgaaaaaacgctatcgcgagcaggctcactcctacaggggtgcatcggtgttgctgtcagtgctggtgtgcgtggcagtcgttgatcgctgcgcgctctttgccgccgagaatgttgaacagcaggttcagcgtcagcgcgctgagcgttgccatggcgatgccgctgtgggtaatcgggctcatccacagcggcagatgcgcgaagaattccggacgcaccaccgggatcaggcccataccgatgctcaccgcgaccagcaactggttgcgacggtcgccgatgtcggcttcctggagaatcttgatccccgtcgcggcgaccatgccgaacatcgcaatcgccgcgccgcccagtacggctggcggaatcgaggcgacgaggaatgccgctttcggcagcaggctcaggacgatcagcaaaccaccggcaacgatggtcaccgaacggcagcgcacgccggtcatctgcaccagaccgatgttctgcgcgaacgaggagtgggtgaaggtgttgaagaaaccggcgacaaacgaggcgccggcatcacacagcaaaccgcgacgcagcatgcgcgggcagacttcctgatcggtgattttgcccagcgcgaggaacataccggtggactcgacgaagatgatcaccaccaccagacacatcgacaggatcggcgccagttcgaatttcggcatgccgaaatgcagcggggtgacgaactgaatccatggcgcgttggccatgccgctcagatcgaccatgccgatcgcgccgcacagcacgtagccgatgcacatgccgatcagtacggagatgttgacccagaaaccgcgcatgaagcggtggatcagcagaatggtgcccaacaccagcgcggcaatggccagataaatcggtgagccgaattgtgcggcggcggcaccgccaccggcccaattcacggccacggggaacagcgacaaaccgatcgaggtgatgaccgtgccggtcaccaggggtgggaagaagcgtacgaccttggacatgaacggcgcgatgagcatgccgaagaaaccggcggcgatcgtcgcgccgaagatgccttgcaggccgataccgggcatgccggccatggcgaccatgctgccgactgcggcaaaactggcgcccatcatcaccggcatgcgaatgcccatcggaccaatgcccatggactgcacgatggtggcgacaccggcgaccagcaggtcggcgttgatcaggaaggcaatttcttcacgactcaggccagcggcctgtccaatgatcagcggcaccgcgatggcgccaccgtacatcagcagaacatgttgcaaaccgaccaggatcagttgcaaaaggggcaatcgctgaatggcgggtgcgtcggggatgcgcgctttggacagctcggacatgcaacacctcggatctttttattcttgtgattaacagctgccgggttgctcacagctgtttctttgcatcaggtaaaaccgcgctaaggcgattcgcgagcaggctcgctcccacaggaaatgcgcgatctctgtgggagcgagcctgctcgcgaagctttgttgcttagttggtctgtgctccctgggcgatccatgcaccgatcaggtcacgttcctgctgggtcatctgcgtgatgttgcccagtggcatgatctgcgtggtgatggcttgcgcctggatgcgcgccgcgttctgacggatctgctcaggggtgtcgagcatcacacccgccggagctgcgctgaacaacggactggtcggtttggccgagtggcaaactgcgcagcgttcttgaatcacgttgtgcactttgtcgaaggccggacctgcgttggaggcttgcgccggcgctgctgcaggtgcgtctgcgggtgcagcaggtgccgccgcttcagccggtttcgcgccaccgcccagtgccgtttccggcagcggttgatactcgattttggctggcgccttggccacttccggagcggtcgacatcggcgttgggccggtgacgtacgccagcgtgatcatgcctaccgctgccactggcagggtccaggcaaacttgtggctgtcgtgacgggtgttgaagtagtgacgcaccaacaccgccaacactgcaatcccggccaggatcaaccagttgtactggctgccataggtgctcgggaagtggttgctgatcatgatgaacagcaccggcagggtgaagtagttgttgtgacgcgaacgcagcaagcctttggccggcagcgccggatccggcgtgcggttctcggcaatcgccgccaccagcgcacgctgcgccggcatgatgatgcggaacacgttaccgaccatgatggtgccgatgatcgcgccaacgtgcaggtacgcaccacgaccgctgaacactttgctgaagccatacgccgcgccgatgatcagcacgaacagaatgaagccgagcagagcagggcgtttgcccaaggccgaatcacagaggaaggagtagatgaaccagccgaggaacagcgagccgataccgatggccaccccttcagggccgctcagtgtgctgcccggagccagcaggtagagcgttgggttggagtagaacaccacgcacagcagcgcaatacccgacatccaggtgaagtaggcttcccatttgaaccagtgcaggttctccggcattgccggcggggccagtttgtatttttccaggtgatagataccgccaccgtggatcgcccacaggtcaccggccagaccggttttcgggttgacgcggttgaggttgttctccagccagacgaagtagaacgacgcgccgatccaggccacgccagtaatcatgtgaacccagcgcacgctcaggttcagccattccaacagatgtgcttccacagtctttacctctcgcctgtcactcttgttgtcgagtgatcagaccttctcttattggtggggggcgaggatcaaacgctcatcctctttgaaaaaatgctcatcgcagttattgcctgtgccactgcgatcaaccaccaggaagtcatcccgcttttcgatcgtcagcaccggatggtgccaaacgccgcgatggtaattgatgccctgcctgccgttggtgacgaaggcgcggaccaagcctgatacaggttcatcgccaactggcgcgaccacgatcagaaaggggttgccgagcagcggtatgaaagcctggctgcccagcggatggcgttccagcatgcaaacggtcaacggcatgtcctgcgcgtcggcgcggaagatgctgatgatcgcgttgtcctcaggctgagcggtttcgaccgtcgccagtttgtggaagcgcatggtcgaaccgttgttgatcatgaagtgatcgctgccgtcggtttcgatcacgtcaccgaaaggggcgaaggcttctttgctcagcggttcaatcgttagtgtgcgcatgctgttcttcttttcgttgagtgatcgttcccacgctccgcgtggaaatgcagcccgtgacgctccgcgtcacatccagaacggacgcagagcgtccagtgatgcgttcccacgcagagcgtgggaacgatcattgcggtgttatttagcgaccttgccgagaacgcgcaggcgactcacaccaccgtccgggaacacattcaggcggatgtgggtgatcgggcccagcgccttgatctgctcgacgaaggtgtgttcggcgtgcatttccagcttctggcttggcagcagttcacgccagaacagcgactgggtttcgatctggctgtcagtaccgcctttcacgaaagcgccttggatcgagcaagtgtccgggtagttgcctttgaagtgcagggtgtcgaccacgatcttctcgatctcgcccgggtgacccagcgcgacgatcacccagtcattgcccggcgtgcggcgacgtgcagtttcccagccgtcgcccatgttgatgccacggcccgggttgaggatgttgctcatgcggccgaagtgttcgtcggagcaggcgagggcgcggccaccattgagggctgctgccagatcgacttgctcgttgtcgccaaccgccgaccagtcgcggaacggaatgccgtacacgcgcagacgggccacaccaccgtccgggtagatgttgaagcgcaggtggctgaacgctttgtcgttgctgatttcgtggtagtggtggctgttgccctgcagctcgacggccgacagcacttcagtccactgggtgttttcatcaggctcgcccgaggccaggaagcacgcctccagagaggccgatggcgggaagttgccggtgaagaatgaagtgtcgatgtccacgcctttgatcgagcccggtacgcccagacggatcactgcgctgtcgaagccttcgaagcgcttgcggcgcgattcccagccgtccatccacttgccgttgtcatcgaacacgccctccttccatacggccggggtcggttggaacagacgattggcgtctgcgaaccagtcatcggtgaccgagatgattttggtgcccagacgggcatcggccaggttgacgaatttttcgaaaggtacggcgtaagctttcattcttcttgtctgcctttaactaagtggctggggatgcttgcgaggccctgggcattctccgcgtctgacatgctcgggccaggcttgctaaagagtcagtaaacggaacagggcgatcttgttgatctccgccagcgcgcatttgaactcggtgtcttgcgagttgtgaatgcgcgtttcgaacgccgcgaggatctgatgccggttgctgccttttaccgccatgatgaagggaaacttgaacttggctttgtaggcgtcgttcagctcggtgaagcgctggaactcttcggccgtgcattggtgaataccggcgccagcttgttcattggtgctggcttcggtcagttggccctggacggcagctttgccggccaggtccgggtgagcgttgatcagtgccagttgactggcgtgatcggcgctcaacaggatgtcgctcatgcgctggtgcagggtttcgatctcgtcgatcgaagcgtccgcgcccaggtcgtaggccttctcggctacccatggcgaatgttcgtagatgtcggcgaaagcgttgacgaaagcgtcgcggctcagggtcgacggttgcagggtttgaaagcggctcatttggcggccccttggtacggctgggtttcgtgccagtgacgcgcgatgtcgacgcgacggctgaaccacacctgttcatgacttttggcgtattcgataaagcgtttgagcgaggcgatgcgacccggacggccgatcaagcggcagtgcagaccgatcgagagcatcttcggtgcgtcagcgccttcggcgtagagcacgtcgaacgcgtctttgaggtattcgaagaagtcgtcacccttgttgaaaccctgcacttgggtgaagcgcatgtcgttggtgtcgagggtgtacgggatcaccagatgcggcttgccggtcgggttgttcggttcccagtagggcaggtcgtcgtcgtaggtgtcgcagtcgtagaggaaaccaccttcttccatgaccaggcgacgggtgttcggcccggtgcggccggtataccagcccagtgggcgctcgccggtgatttcggtgaggatgcggatcgcttcgagcatgtgctcgcgttcctgcgcttcgtccatgtactggtagtcgatccaacggtaaccgtggctgcagatctcgtggccggcatcgaccatcgcacggatcacatccgggtggcgctgagcggccatggcgacggcgaagatggtcaacgggatgtcgaattccttgaacagtttcaggatccgccagacgccggcacggctgccatactcgtaaagcgattccatgctcatgttgcgcgcgccttgcagcggctgagcagcaaccatttcagacaggaacgcttcggattctttgtcgccgtgcagaatgttgcgctcgccgccttcttcgtaattgagcacgaaggacagggcgatgcgggcattgcccggccagtgtgggtgaggagggttactgccgtaaccgatcaggtcgcgtgggtagtcagcgctcactgcagtcttccttcttgttcgttgacagatgggtgtggcggcctggcaggcttgcgtcacagcgatgggctgattgtatacaactttaatcgcaatttgtaagcctgaattttcgcatttttcaccgactgtcatcttttgctgttaatggcgtgagcctgcaagaaacctgcctgatcagtcagctaatggattgaaagttcaatgttcaggcactgtgctggcagatcgggggtaaaggcccgggtagcgggggtgcaggaaaaaatgtcgtttttattgtgtacaatttttttgaaaagtgtcttaatcaatcgctcgccgcagcttttcgtgctccgaatcggtgcggtctccttttcaactgacttcgggaggcgcgaggtctgactgcttccacgcaggcaggcgcgcagaatcaatgggacgtttgacaacacacgttttggacgctgcacacggttgcccgggcagttcgatcaaggtcgagctgtaccgcgttgaaggttcgcaactggaattggtcgccagtgccgtcaccaacagcgatggccgggtcgatgcaccgctgctgcaaggcgatgactatcgaaccggcgtttatcaggttcagttccacgcgggcgattactaccgcgcccgtggcgtgcagttgccggaaccggcatttctggacgtggttgtgctgcgtttcggcatctctgccgaacaggatcactaccacgtgcctttgctgatttcgccttacagctactccacgtaccggggcagctgacccccaagcagctgcccccaccgggaagcgactgcgcatatagcttctttggtctttcgcccgctcacactgcgggcttttttttgcctgtcttaagtcaaaagtcgcagcctgcggcagctcctacagattgacgtgcaatcccatgtagtagctgccgcaggctgcgatcttttgcttttaaccgctcaacagggacgcggcgcccgcaccactgaacaacccggcactcacccgattgaaccaactctgccccttgccactgcgcaaataccgcgccgcgccatgcgcacccagcccgtaagccagtttgcagcacagatcgagcaccacccacgtcgcaatcatgatcaacaactgcggcaggaacggctgctgcgcgctgagaaactgcggcagaaacgcagcaaagaagaggatgtctttcggattgctcgcgcccaacacaaacgcacgcccgaacagcgtgcgaaagcgcggtgtcggtgcagcctgaggcacttctgcgcccaccgatggctggcgcgattgctgccagctctgccaggcgagatagaacagatacagcgcaccaacgattttcagcgcgctgaacagctgctcagatgccagtagcagggcgccaagccccaatgccgacgcactgagcaaacagatcgacgcaatcacgccaccgagaaacgccgggtacgaccggcgcagaccgaagttcagactgttgctgatcatcagcagcgacagtggccccggaatgaggatcaccaccaatgcagcgccgctgaacagcaaccaggtttccagactcatcattttcctcctttttgttgtactgaaaaatgcacaaaagccccacccgtgagggtgaggccgttttaaagcctgaaccgcgtagcgcttacaggaagatgaacttggcgatgaagatcgcgcagagcacccacaggctcacggagatttccttgtacttgcccgtaccggccttcagcgccacgtaggtgatgaagcccagtgcgataccgtcggcgaccgagaaggtcagcggcatcatgatggcggtgacgattgccgggatggcatcagtggcttcgtcccactcgatgtgggccatgccgcccatcatcagcatcgctacgtagatcagtgcaccggcggtggcgtaagccggaatcatgccggccagcggtgcgaaaaacattgccgctataaatagcacacctacggtcactgcggtaagaccagtccgaccaccagcggccacaccggcggcactttctacatagctggtgacaggtggaacaccgaccactgcaccgaaaacgctggacgcactgtcggccttcatcgcgcgggaaaggttttcgatacgaccgtcagcgttgaccagattggcgcgctgggcaacgcccatcagggtgccagcagtgtcgaacatgtgcacaaagaggaacgccaggaccacgctgatcatgctgacgttgaatacgccggccacgttcatcgccatccaggtcggtgccaggcttggcggcgcggacatgatgccttcgtagtgaacgaggccgagaccccaacccgccagcgtcacggtgatgatgctgatcaggatcgcgccgaacacgcggtggtagctgaggatcgcaatcatcaggaagcagatggcggcgagcagcgggccgggttctcgcagagaaccgagtttgatcagggttgccgggctatcgacgacgatgcccgcagttttcagaccgatcagaccaaggaacaggccgacaccggcacccatcgcaaaacgcaggctgacgggaatactgttgagcagccactcgcgaatccgcgagaaggtcaggatcatgaacaacacaccggacacaaacaccgcaccgagcgcggtttcccagttgtagcccatggtgccgaccacggtgtaggtgaagaacgcattgaggcccatgcccggcgccagacccaccggccagttggcgtacagacccatcaacaggcagcccagcgcagcggcgatacaggtggcgacgaaggctgcaccgtgatcgatcccggcatcggccatgatgttcgggttgacgaagatgatgtaagccatggtgatgaaggttgtcagaccggcaatcagctcggtcttcaccgtggtgccatgcaagctgagtttgaacagacgttccagcaagccactgcgtaacggtggcgagagatccagcggcgatgcttcggatttgcggctttccacagcgagtactcctcaagagttttattgttatttccagggccggacccatgaggggtggcagcggccctttgaggcacttgcgaatttgttgaccatgcggtcaggaactcgcacgctgtggattatgcttttgtgtacaaataaagcaaatattgtttttggttttgtttacggaagttccgtcgatagcgatatatcgcctgcactggccccttcgcgagcaggctcgctcccacatttgaaatgcgatccccagtgggagtgagcttgctcgcgaagaggcagtcccattcaatcgagtgccgtctgacttttccccaacgccagattcaccgccaaccagccattcaccgccgcctccccagcctcggcaaacacccgctccagcaacttcacctgctcacgccgcaacgcctgctcgaacttcgcgccttcggccgtcaacgccagcaaccgctttcgcttgtcagcttcagacgcgacgctgtcgaccaggtgcatttcctgcaattgccgcaatggcatgttcagcgcctgcttgctcacaccgagcaagccgagcaattccttcacactcaaattcggataccgcgcgatgaaaaacacaatgcgctgatgcacccgcgagaggccgcggcgttcgagcatttcgtcagccttggcggtgaacgcctgatagccaaagaaaaacgcttccatcgcctgttgttggcttgcagggtttttaaggtcaagcatgttgacgtactcgctcaagctgtcgtaatttcagtcaactagtttgactcatttttcgtccgcctcgctaccggtgacccccatggctttttccgaacgtgtctcgcgccttaaaagttctttgatccgtgaaatccttgccgccgcccagcgcccggaggtgatgtcgttcgctggcggtttgcctgctgaagccatgttgcccaaggttgagtgggccgacatgccgctgtcgctcggtcaatacggcatgagcgaaggcgagccggcattgcgcgaggctctggcggcggaggcgagggcactggggctggaatgtcaggcgagtcaggtgctggtggtcagcggctcccagcaaaccctcgatctggcggccaagctgtacatcgacaagggcacggaaatcctgctcgaagcgccgacctatctcgccgccctgcaaattttccaattgttcggcgccgattgcctgaccgttccgcaagagtccgatggtccgaacctggtgcagttgcgcagtcgtctggagcagcatcgtccggcgtttatctatctgatcccgacgttccagaacccgtcagccgtgcgctacagcgaagccaagcgcgccgccgttgcggcattgctcgatgaattcggcgtcaccctgatcgaagacgagccttaccgcgaactgactttcgatggcggcagcgccaagccgattgccggacgcctgcagaaatccagctggatctacaccggcacggtgtcgaaaaccttgctgccgggtttgcgcgtcggctacctgatcgccagcccggacctgtttccgcatttgctcaaactcaagcagtcagcggatctgcacaccaaccgcatcggtcagtggcaggcgttgcagtggatcggcactgagaaatatcagcagcacttgagcgaattgcgtggcttctatcggcagcgtcgggatgcgtttcaagcggcgctggaaacgcattttgctgatctggccgactggaacatgccccagggtgggctgtttttctggctgacgttgaagcaaccgctggatacgcgaacattactcaatggagcgttggccaatgatgtggcgtttatgccgggggagccgttttttcccgagccggataatcatcatgggcatttgcgcttgaacttcagccacatcgatccggcgcggctggatgaagggctcaagcgattggcggcagtgatacgacaggcgcagctggataaagcggcgtgaaaaaataaaccggctcatgggccggtttatttttgtctgggatttttggtgcctggaatggcctcatcgcgagcaggctcactcctacaattggaatgcgttcccctgtaggagtaagcctgctcgcgaaggggccatcagccccaatacagaatcatcagaccgccgcgaagcgcttatccagataatcaataatcaccttggactcatacatccaggtcgtctggccattctcgtcaatgcgcaagcaaggcaccttgatccggccaccctgttccagcagggcctgacgatcctgctcgttattcttcgcatccttcagcgccaccggcacattcaggcgacgcagcgtgcggcgggttttcacgcagaacgggcaggcgtggaactgatacaaggtcaggtcttttgcagcggcatccacctgagcctgagcagcggcggggcgttttttcttgcccggacgggtgatgaagtcgatgaagataaccagttggccgaggccgacacgaagcgctttgacaaacacgttgaaagcctcacggtgcaaataaagaaaggcgcgcagcttacccgatttttcacgggcgaaaaaaaaccggcgatgaatgccggttttcttcgtacagcaaattacttgatcaggctgagaaactcgctgcgagtcgcggcattttcgcggaactcaccgagcatcaccgaagtgatcatcgacgaattctgtttctcgacaccgcgcatcatcatgcacatgtgcttggcctcgatcaccaccgccacgcccagcgcgccggtaacttgttgcacagcgtcggcgatctgacggctgaggttttcctgaatctgcaggcgacgggcgtacatgtcgacgatccgcgcgaccttggacaggcccagcactttgccgctcgggatgtacgcaacgtgcgccttgccgataaacggcagcaggtggtgttcgcacaacgagtacaactcgatgtccttgaccagcaccatttcgctgttgtcggagctgaacagggcaccgttggtgacctcttcgagcgtctgttcataaccgcggcagaggtactgcatggctttggcggcacgctttggcgtgtcgagcaggccctcgcgggacacgtcctcgcccaattggccgagaatcgcggtgtaattctgttccagggacatgaaactacctgtggggattttcgcaaagggcaagggtacggtggcggacacaaccctgcaagttcggtgtaacgggattattcgtcgcggccttccatcatcgtgcgtttaagcatcacgtacaccgcgccggcaccgccatgtttggcctggcacgagcagaaacccaggacctgcgcatgctgacgcagccaggtgttgacgtggcttttgatcatcggccgcttgccgtccaggcgcacagccttgccgtgggtgacgcgcacgcagcggatttcgaatctggtcgcttcagcgagaaaggcccagagggtttcgcgggctttctcgacgctcatgccatgcaggtcgaggctgccttcgaacgggatctggccgaccttgagcttgcgcatctgactttcctgcacgccgtcacgcgcccacatcaactcgtcttccgggccgacgtcgatcacgaactgatcggacagaccatcaacggtagcggtgtcagtgcgcacggtggcggactggcgcagcttggcgatctgcgcgcggtcagccttgggtttgccggtgtcggcgcggtcgtgtttgatcggcttgacgccgcgcaactcgtttttgaacagggaaaaatcgtcgtcttgcatgtcagcctccgcgaagggcggccagtttacccaagtcgaaacaaaacggcccggcaaaaagccaggccggtgagtcagtcgtgttttttcatcaggtgcggggacatgttcaattcccgcgattgccgtgcgcgacggcggcagcggcgccacagggcaacaccgaaatacagaaacagcaaaccgaccgccagaatgatcgccgagcccatcggcgtggcgttcaagtcaccgagtgccggtgggcgcccgagcaggctggccgccccggccatcgccagcagcacaccgaacgtcgccagaatggcggcgatcgctgcgccgaatcgaaaacgccagttgctttggcctttgggccgcaagcggcgtgcgtcaaatccatcggataacttcattccgaccttcctcaatgggtatcggcccttcgaccgggagttgaccgggttgttcctgaggctatggcatttgcggcaaatgagagggttttgcggatgagcggcgccgtgagccgctcatcaaagcagatcagatcaggtcttgagtcagcgcgagggtggcgaagttgtccgccatgatcgccatttcggcttcctgcaccacggcggcgctgagcacgcggcccttgaatggcagatcacgggtggcgcaggcgtcttccaccagggtgcagcggaaacccaggttcttcgccgcacgcacggtggtgctgacgctggaatggctcatgaaaccgcagacgatcaggtccagcgagccaaggttttgcagacgatcgagtaattcggtgccatggaaggcgctcggcagcagtttgccgataatggtttcatcaccttgtggctccaggcccgggatgaattcgccgcgttcgccctgcgggtcgaacaggccaccgacggtgccgagatgacgcacgtgcacgatcggccgaccggctgcacgggctgcggcaaccacttgtttgatgttcgcgacggccgcgtccatgccgctcagtgccagcgggccactgagatattctttctgggcatcgatgatgaccacggtggcatggctcagtgtggccgctgcgtaaccgcgaccgctgagttgaaacatcgtttttggaacggacattctggggctccttggggtggggcttttgcgacattgtcctctggctgagcggttctgtgaatcgctaccatcgtaggcaccgtcgttattggcctgcagccttgtcacgttacacgttctgttcaacggctggtgcaaaaaacagaaaactcctaccgtcgcccggatgattttcctgcgtcgtcgtcatgcgttttggctggtagaatcgccagtcgttttttcaggagttttgcccgtgatcacttcccgacttcgtaccctgcgcgaccacatccgttgggccgtcagccgcttccatggggaggatctgtttttcggccatggtaccgacaacgcctgggacgaagcccggcagctcgtgctgggagcgttgcacctgccatgggagatcgccgacagctacctcgactgcgcgctggaagacgatgagttggtcaatctgcaacgcctgctcaagcgtcgtatcgaggaacgcattccgaccgcttacctgttgggcgaggcgtggttctgcggcatgtcgttcatcgtcgatgagcgcgtgttgatcccgcgttcacctatcggcgaactgatcgaaaaccattttgcgccgtggatcggcaccgaaccggcgcggattctcgacctgtgcacgggttccggctgcatcggcattgcctgcgcctacgagttccagaacgccgaagtggtgctggcggatctgtcgttcgaggcgctggaagtggccaaccagaacatcgagcgtcatggcgtcgatgagcgcgtgtacaccgtgcagggcgatggtttcgatggcttgccgggtcagcgtttcgatttgatcgtgtcgaacccgccttatgtggatgcggaagatttcgccgacatgcccgacgaatatcagcacgagcccgagctgggcctggcgtgtggcgatgatggtttgaatctggttcgacgcatgcttgccgaagcggcggatcacttgaccgagaaggggttgttgatcgttgaggtgggcaacagccaggtgcacgttgaagcgctgtacccggaagtcgattttgcctggctcgacttcgagcgcggcgggcatggtgtgttcatgttgaccgcagagcagtgccgcaaccaccaagccctgttcgcctcccgcgtctgacccgttaaaagcaaaagatcgcagccttcggcagctcctacagggattaccgcattccaatgtaggagctgccgaaggctgcgatcttttgatctaccggtgcgtagcaatccagatcaacagccctgcctgaaacaccgcaaacgccaccagacaggtaatggtgaaacgcaagccagcgtcttcacgcttgaacttgctgaccttgtcttcctgcttcttcagcttcacttcctgctcggccagattctgctcggcctgttgaagcatttgcgccgcttcaagaatctcgacgatctgcagcttttcgctgttccagtcgccgagcaaatcgccaacctgcacttccttgacgctgcccttcaaatgctgggcatcggcatagaccacatcaaaaccatgcacacgcaggaaatgatcgcgacgcagacgggtgtcttcgttcagcgcgtccttgttgttcaggtccatgccgtcgacggtgtaggtcggccaacgctttttcacccaattgatgccttgggcggccatgtagcggccgatgccacggttcatcggttcgatctgcaagccgctgtcggggccgaagtgaacacgcttggttgtgtgatccacccacacgtccaattgattctgctctttgcgtacgcgctggcccggcagtttgatcgccatgcgcatcaggcttttttctttgctgttgcgctcggcgtaaccgaattcgacgaagcgcaacggcctcccgcccgtgttgcgatcggtctgcagcggggccaggcggagcatcttgtggtgctcgacgtggacatccgcccacggcagctcgaccgctggcggtgcgtctttttccgcggtggtgtcgggtgaagtctgggtatcagtcataacggcgagatcctgtccaagccctgcttgtcgctagccattgcgctggcgacaaaggcttatcggccgtttctttcaggactagagggtaaacggcgcttatcaggtgcgaagtccgtcaataaactcgatgatcttcgcgccgagctctgcggccagtggcaaattcggatccttgtaggaggccagttgccgcttcatatcgttgtgcacaatgcgcatgacatggttcatgccttcgatcaccaccagttcggcgtccggtttggcagccttgagcagcttcgcgtcatccacgccgacctgaatgtcgttactgccttgaacaatcagtgctggcatcttcagttgcgcgaaagccttggccggatcctgacggaacagcgaaatcagatacggctgcacactcgggcggaaaatcacctgcaatggttgcggcacattgtcatcggtgtggccggccttgaggctgtcgagcagttcgttgctgcgcagcatcaagggtggcggcaggctgcgggccagttgttcgcggatcacctgatcgaccggacgggcgctgccagagagggaaatcactgctgccgcatctgccgtcggtgccgccagcgtggcaatcatcgcgccttcgctgtggcccagcagaatcaacttgccgaaacgcggatcagccttgagcttgcgcgcccaggcctgcgcatcggcgacataggcttcgaccgacaaattgcgctcatccggcgtcgctgccaggctcgcggccacgccgcgcttgtcgtagcgcacgctggcgatattgtgtttggccaagacccacgccaggcgcttgaggctgtcgttgcgcccaccgtcggggttgtttccgtcgcgatcagtaggacccgagccagaaatgatcaggacaaccggcaccgggttgtcggactttggcagtaacagcgagccgaaaagctcgccggtgccggtatccaaagttaccgggcgttgtaggaccgtcgcttgggcaaagcccgtaaagagggtaagactcaagagcaaaactcgcagcatcatcacgccatcattggtcaaggtgccggttggactcgccaacaccgctaaggttcgaggatgaactactcggttagcctgcgtatactggcgcgcatcacgaatttgggtttgatttcacggagcgtcctgcatgtccggcaatacctacggcaagttgttcactgtcaccaccgcgggcgaaagccatggtccggcgttggtcgccattgtcgacggctgcccgccgggcctggagatttccctcgaagacctgcagcgcgacctcgatcgccgcaagcccggcaccagccgccacaccacccagcgtcaggaagccgacgaagtcgaaatcctctccggcgtgttcgaagggcgcaccaccggttgctcgatcggcctgctgatccgcaacaccgaccagaagtccaaggactactcggcgatcaaggatctgttccgcccggcccacgccgactacacctaccaccacaaatacggtgagcgcgactaccgtggtggtggccgcagctcggcgcgcgaaaccgcgatgcgcgtggccgccggtgcaatcgccaagaaatacctggccagccaaggcatcgtcattcgaggctacatgagccagctcggcccgatcgagatcccgttcaagacctgggattcggtggaagagaacgccttcttcagccccgatccggacaaagttccggagctggaggcttacatggaccagttgcgccgcgatcaagactcggtcggtgcgaaaatcactgtcgttgccgaaggcgtgatgccaggtctcggcgagccgatttttgaccgcctcgacgccgaactggcccatgcgctgatgagcatcaacgcggtcaaaggcgtggaaatcggtgccggattcgcctcggttgcccagcgcggcaccgaacaccgcgatgaaatgaccccgcaaggtttcctcagcaataacgccggcggcatcctcggcggcatctcgtccggtcagccaatcgttgcccatctggccctgaagccaacgtcgagcatcaccacgccgggccgttcgatcgacatccacggcaaccctgtggacgtcatcaccaagggccgtcacgacccgtgcgtcggcatccgcgccacgccgattgccgaagcgatgatggccatcgtgttgatggatcacctgctgcgtcaccgtggccagaacgccgatgtgcgcgtgagcaccccggtgctgggtcagctttgatggcgggccctgaagccgtcgcggcataaccgtggcggcgctcccttactggcggctgtccagtttctatctgttctatttcgccttgctcggttcgacagcgccgtttctggcgctgtacttcgatcatctcggcttcactccggcgcggatcggtgaactggtcgcgatcccgatgctgatgcgctgcgtggcgccgaacatctggggctggctcggtgattacaccggcaaacgcctggccatcgtgcgcttcggcgcggtgtgcacgctgctgaccttctcgttgattttcgtcagcaagacctatgcctggctggctatggtcatggcgctgcacgcgtttttctggcacgcggtattgccgcagttcgaagtcatcacgctggcgcatttgcaggggcagacctcgcgttacagccagattcgtttgtggggctcgatcggtttcatcatcaccgtggtcgcgctcggtcgtctgttcgaatggctcagcctcgacatctacccggcggcgctggtgttgatcatggccggcatcgttctcagcagtctgtgggtgccgaacgcgcaaccgccgcaaggcaatcgaccgagcggcgatggctttctcaagcaactgcgcaatcccggggtgctggcgttttacggctgcgtcgcgctgatgcaaatgagccacggcccgtattacacctttctgaccttgcacctggaacgacttggctacacacgcggcaccatcggcatgctctgggccgtgggtgtcgtcgccgaagtgctgatgttcatggcgatgagccggattcttgcgcggttttccctgcgccgggtgttgatggcgagttttctgctggcggcgctgcgctggttgctgctaggttcgttcgccgagttcctgtgggtgctgttgttcgcgcaggtgctgcacgcggcgaccttcggcagttttcacgccgccgccatcgccttcgtgcaacgtagcttcggcgcccgccagcaagggcagggccaggctttgtatgcagcactggccggcaccggcggcgccatgggcgcgttgtattccggttacagctggaatgccctcggcgcgacattgacctttagtattgccagtctcgcggcgctcgctgctgccgttatcattgccacacgtatgcaagaggacaggccatgagccttacgcgtgaacaactcgcccagcaaatcgtcgacgccgggcgttttctgtatggtcgcggctggtcgccggccaccagcagcaattactcgacacgcctgtcgccgagcgaagcgctgctgaccgtatcgggcaagcacaagggccaattgggcctggacgatgtgctcgccaccgatctgtcgggcaacagcctggaaccgggcaaaaaaccgtccgccgaaaccctgctgcacacccagctgtatagctggcggccggagatcggcgcggtgctgcacacccattcggtcaacgccacggtgctgtcgcgcctgaccccggaagactttatcgagttcgaagattacgaactgcagaaagccttcagcggcatctccacccacgaatctcgggtgcgcgtgccgattttcgacaacgatcaggacattgcacgcctcgccgccaaagtgcagccttggctcgacgcccaccccgattgcgtcggttatctgattcgcggccacggcctctacacctggggcgcgcagatgaatgacgcgctgcggcagatcgaggcttttgaatttctgtttgaatgcgagttgaaaacccgcagcgtcatgaaccgccaaggctgacttcacccgaagtagcccatttgcctgatgaaatgctgtgcccgaccggtctgcaagaaccggacggcaaggccgataccgaggaattgccccaatgagcagcctgtccgtctatcacgtttccagccccgatattcccaacaaggtgctgacccactttgaagacatcgcctcgaccctggccgagcagggcgtgcgcttcgaccgctggcaagccgccgcaaagatccagcccggtgctacccaggaagaagtgatcagcgcttataaagaacagatcgaccaactgatgaccgaacgcggttacatcaccgtcgacgtcatcagcctgaacagcgaccacccgcaaaaagccgaactgcgcgccaagttcctcgaagaacatcggcatggcgaagacgaggtacgctttttcgtcgccggccgtggcctgtttaccctgcacatcgacgattacgtctacgccgtactgtgcgagaagaacgatttgatctcggtaccggccggcaccaagcattggttcgacatgggcgagcatccgcacttcgtcgcgatccgcctgttcaacaaccctgaaggctgggttgccaatttcaccggcgaagacatcgccggtcgtttcccgcgtctggaggactgattcgatgtcgatcaaagccattgtcactgacatcgaaggcaccaccagcgcggtgagcttcgtcttcgacgtgctgtttccgtatgcggccaaacacctgccggacttcgtgcgccaaaacgccgaacgcgccgatgttgccgagcaactcgacgccgtacgccgtgacagcaatgcgccgcaggccgatgttgagcgggtcgtcgagattctcttgagctggatcgaggaagatcgcaaagccacgccgctcaaagccttgcaaggcatggtctgggcccagggttatcacgccgggcagttgaaagggcatgtttacccggatgccgtggaagcgctgcgacgctggcatgctgccggttatcaattgtttgtgtattcgtcgggatctattcaggcgcagaagctgattttcggctgctccgaggcgggggatctgacgccgctgttcaacggttacttcgacaccacgtcggggcccaagcgtgaggcgcagtcgtacaccaatatccagaaagccattggcgtcgaacccgaagaaatcctgttcctctcggatatcgtcgaagaactcgacgccgcgcaagcagccggcctgcaaacctgcggcctcgcccgtgaaggcggcgaactgggcagccacatcaccgtcgacaccttcaccggcatagaacccgaagccttctaacccacacaatcccggtaggagctgcggaacgctgcgatcttttgatcctgatcttcaaaaacaagatcaaaagatcgcagcgttccgcagctcctgcaaagagttcgcgatcacgatagagatcgcgcacaaaaaaacaggccgtgaagcgcatgctccacggcctgtttcgtttaaagcggtttaagcgttacagcgagtgataagtcggcagcgcaaaacgctgctggctctgcagcatggcaatttgcggcagttcactggcttgttcagccaggtcacggcgaattgcactgatcgcccacgacagttggtcgccggcatgcagttgttgataagtcagtgcgcgcttgaacactttgccgtcgccgctgcgcagagtcagcagaatcccgccatcgggacgtggcgcagtggtgacgtcgaagttggagaacagcgaggtaaatttttcttgaatcaggctcatgtctttcagctccgtatgcacttgaatggcaagcatgcagaggaggttgcagcgattgtgccagcatttgaaaataaaattatcgttataaatcaatggtttaaaaattattaaaattcagggtgtcgtgcaatctgcatgaatggccatcgtgcatcctgcattttgagggattgtggtcgatcctgcggaaccaatcgttctgttgaggatcaccgcgagtcccggcaggtcggcggatacaaaacattgcaaaaaccgcgtgtacagcccgagaagcgctgacgtattttcgatctcgacctgcgctcggatgcgtcggttgcttcaagccaaagcccgaaaaataaaaacatcggcctgcacgccaaggtcgaacggggagcttccatgcgtcacgcgccaagcgacacgattacctggagcatgatgctccgcaaactgccgatgattgccaaagccatcccgcgggtggtcaagggcatgaaggtggccaacgtcacggatccgacccaaagctgtggccttggctttacattcgagcaagcgacgctgcgcaatcccgacgggccggcgttattgcacggtgacgtggcgctgacctattcgcaggtcaaccaatgggcgaaccgcatcgcccactatctgaacgggcagggcatcggcaagggcgatgtggtcgcggtgttcatcgaaaaccgcccggaattgctggtgaccatcctggcgctggccaaggtcggtgcggtcagcgcgctactcaatacctcacaaacccgcgacacattgatccacagtgtgaatctggtggcgccggtagcgattgtcgttggcgaagaattggttccggcttatgcggcaattcgcgatcaagtggcgatcacggcagcgcgcacctggtttgtcgccgatcaggacacctacagtcatccgggcattgcgcccgaaggctacgtcaatctgatcagcgtcagcgccgacgcagccagtgagaatccgtcgagcagccagcagatcttcttcgacgatccgtgtttctacatttacacctccggcaccaccggcctgcccaaggccggggtattcaagcacgggcgctggatgcgcagttccgccagtttcggcatgatcgccctcaatatgggacccgaagacgtcgtctactgcaccttgccgctgtatcacgccaccggtctgtgcgtgtgttggggctcggcggttaacggcgcttcgggcttcgcgatccgccgcaagttcagcgccagccagttctggaacgacgtgcgccgctatcgcgcgacgaccatcggctacgtcggcgagttgtgccggtatctggtcgatcaaccggccagtgccgacgacaaccgccacgacgtgcgcaagatgatcggcaacggcttgcgccccggtgcgtgggcgcagttcaagacgcgcttcgcggtggatcacatctgtgagctgtacgcggcgagcgacggcaacatcggtttcaccaacatcctcaacttcgacaacaccatcggtttctcgctgatggcctgggagctggtggcttacgatcacgacagcggcgagccgctgcgtagcgaggacggcttcatgcgcaaggtcggcaagggcgaacagggcctgttgctggcgcggatcgatgagaaagcgccgctggatggctacaccgatccacagaaaaccgccaaggttgtccttcacgacgtgtttagcaaaggcgaccgtttcttcaacaccggcgatctgttgcgcaacattggtttcggtcatgcgcaatttgttgatcgccttggcgatacctaccgctggaaaggcgagaacgtctccaccacggaagtggaaaacctgctgctgcaacacccgctcatttccgaggccgtggcttacggcgtggaagtgcacaataccaacgggcgcgccggcatggccgcgatcacgccggcggaatctctggccactctggattttgccgaattgttgagttttgcgcgccagcgtatgccggcttacgcggtgccgttgtttctgcgggtcaaggtgaagatggaaaccaccggcaccttcaagtatcagaaaacccgccttaaaaaagaaggtttcgaccccggccagacgggggatgatccgatcttcgcctggctgccgggcagcgaaacctacgtgcaggtcaccgatgaagtgttggccgacattcatcaaggcaaataccgttattgattctggctatggctggacttgagagaaagggggtgacagcgtccgtcgcgctcgggaaactgtcggctttccgattgaccgaaagtggagttgccccatgtccgaccaaagccgccagatgacccctgaggaagctgccgaattcaccgagcaggttttcaacaaggcgcgtgacggtgatgccgagatgctcgatcgcctggtcacggccggtttgccggtgaacttgaagaacagcaaaggcgacacgctgctgatgctcgccagctactatggccatgtcgatgcggtacaggtactgctcaagcacaacgccgacccggaaatgcgcaatggcaacggccagagcccgattgccggtgcggcgttcaaaggcgatcttgcggtggtcaaggcgctggtcgaggcgggcgccgagattgaaggctcgtcgttcgatggccggactgcgctgatgatggcggcgatgttcaaccgtgttgaaatcgttgattacctgatcagcaagggtgccaatgcgcaggccaaggacgccaatggcgtgaccgcactggatgcggcgcgcaccatgggtgccgtcgataccaccgctcaactggaaaaactccaggcctgataaggtcaaaagatcgcagcctgcggcagctcctgcactgatcccttgtaggggctgccgcaggctgcgatcttttgctttgtgcgctatcctccgcgccctcaaaattcaaatccacaggatctgccctcatgaaagccgcactcgtcgaactcatcagcaaaatcagctccggctgcatgggcgaggacgagatcctgaacgtggccgacgaagcggcgcaggcctacgccgataccgacgcctttctgaccgccaatccggacatcaactacgacgacagcttcccgatcccgttgggcgagtgggtggtggttggcagcttgccggaaaccgtgctgttccaggccgacacctacgtcgatctgtttgcacagatcgttgcctcgttcggccctggtgtggatttcaacctcaagcccaagcaactggccaagaccgaagcgctgaccgcgctcaaccgcatccaggtgcagatgagcagcatgaacaaggaaaacggcggctacacgctgatgaacttcagccagttgctcgacgacgaactgcaaatggtgctggtttacggcaacgacgtgccacgcgtgctggaactgtgcgccgaagtcggcatcgccgccgcgccatcgctggaagccttgaagatcgccgttcacgtctgaacgcaataaaagggaaccctgcgcccgaccgtctatcctaaaagtgcatgccactattctggagcgacaccatgggttccacgttcaacggtctgatcggcctgatcatcctcgccctcgacatctgggccatcatcaatgtgctgaaaagcggcgccaccaccgggatgaaaatcgtctgggtgctgctgatcatcctcctgccggtactgggcctgatcatctgggcgattgccggaccacggggcaacgtgcggatctgaatcagctaacaccgcaatacccctgtaggagctgccgaaggctgcgatcttttgatcttgcttttaaaaatcaacgtcaaaagatcgcagccttcggcagctcgtacaaggattgtggtttgccgatgaagtgaggttcgacctgtcatcttcggcaacgtagaatgcgcgcctttcccgggcaatcgtccccacgattgacgcccgcgcattcatcggagcacttcaccatgaccgtcaccaagaccagcgagtacctggaaaccctctacgaaggctacggccagcgttttcgcatggaaaaactgctgcacgaagtgcgcaccgaacaccagcacctggtgatcttccagaacccgcgcatgggccgtgtcatggcgctggacggcgtgatccagaccaccgaagccgacgaattcatctaccacgaaatgctcacccacgtgccgatcctcgcccacggcagcgccaagcgcgtgctgatcatcggtggcggtgacggcggcatgctccgtgaagtgaccaagcatgctggtgtcgagcacatcaccatggtcgagatcgacggcaccgtggtcgacatgtgcaaagaatttttgccgaaccactccagcggtgcctacgacgatccacgtctgaatctggtgatcgacgacggcatgcgtttcgttgccaccaccacggaaaaattcgacgtgatcatttctgactccaccgacccgatcggcccgggcgaagtgctgttctcggagaacttctatcaggcgtgccatcgctgcctgaatgaaggcggcatcctcgtgacccagaacggcacgccgttcatgcagatcgacgaagtgaaaaccaccgctggtcgcctcaatagcctgttcccggactggcacttctaccaggcagccgtgccgacctacatcggcggttcgatgactttcgcctggggctcgaccaacccggcctaccgcaagctcagccgtgaaaccctgcaacagcgcttcatcggcagcggcatcgtcacccgttactacaacccggaaatccacatcggcgcgttcgccttgccacagtacgtgctgcaggcgatcaacaagccaagcaacgattaaaaaaacaccgcaatacccctgtgggagcgagcctgctcgcgaaatcggactgttgatcgtttccacgctctgcgtgggaatgcagccggggacgctctgcgtcccaaaagatcgcagcctgcggcagctcctacagtgacagatgtcgttcttttcatctccgtccgctgtaatccttttgaaccaacccccggcgtataagtcgagataggtgtaagcccatttgcgggtttgatcgaggaggcaccgatgcaaaagtggaaagtcactttcgtggacgatcatggtgaaattgtcgatgaggtgttcgagcgcgcggaatgccccagcgacgatgaggccgctcgattgatcaaggcacggcttttgcccgttgccgccgaactggacctgaacgatctggaagggcgcaccgccgatgctggcgtgaaaagtctgaaaacccagaacagcatcgaaatccgcagcatcactcccgtctgacattcttcctgtcacctttcacaccagaccttggcagcggctctaacttggggctactctgcaagcgagatcagcgaacggatcgctaaggtctggtcttgtcagctacatgcttgtttcccgcgtgcaaccacgttgccgtagtacttaggccaaaggcccggggcgggaatacggaaagtctatccatctatgcgagggggacgattcatgagcacagcctatcaagaagacatcagcagcaatgttctgcgccgcatgaaagaaggcggtttcgatttttcccggttccaccccatcgagttctacgccattttcccggacgaggagcgggcgcgcagggcggcaggcaaatttcgcggtgagtccatcaatgcccaggtcagtctgcgggatgacggtgcgtgggcgctggaattgagcaaagtgatgtacgcgacgtatgacgatattggcgatttcgagcagggcttttcggcagtggtcgagcccttgggcgggataatcgaggggtggggggtgaaacaggaggtgcgtagccgccaccggttgaattgaatttttacagatagaagatcaaaagatcgcagccttcggcagctcctacaggtgatcggtgtaggcgctgtcgggggctgcgatcttttgcttttgctttcaaaacatttccaaaaggcaaaaaaaagccaccggagagggtggctaaaagggaagaccgataaggagaggaaaccggtcagggttacagcggggcgggctgcgagggcagtccagatcagttgagctggcgacttcgaggcgctgagcgcggcgaagttttgcagcgaatgcgcggattatccgcaggcagtgccgggcagtgaaatcaactctgactatgctggtgataggcgatgcagtgcgtcgcaatgaagcgggggcaatccggttggggcatttgccgcacaggaatggtgcggtgcctgcggattgaatatccaaccgattgaaatcaaagcgtttatgccgatggcacgggccttgcgaaggcctgtatgtccgggtgacaaggagtacggcatgatccgcacctattttgatgagatgtacgatgctggcggccaggttcgcccgcattatcgggagttcgcccgctggctggccgacacgcctgacgagctgctggcccaacggcgacgcgaggctgacttgctgttccatcgcgccgggatcaccttcacgctctatggcgacgagcagggcaccgagcgcctgattcctttcgacaccatcccgcgcagcattcccgccagcgagtggcgaatcgtcgagcgcggctgcatccagcgggtcaaggcgttgaacatgttcctcgccgacctctatcacgagcagcgcatcatcaaggccgggatcatccccgccgaacaggtgctggccaacgagcagtatcagttggcgatgcaaggcctggatctgcaccgcgatatctattcgcacatctctggcgtcgatctggtgcgcgatggcgacggcacctactacgtgctcgaagacaatctgcgcacgccgagcggcgtcagctacatgctcgaagaccgcaagatgatgatgcgcctgttcccggagctgttcgccgcccagcgtatcgcgccgatcgatcactaccccaacctgctgctcgacaccctgaaaagctccagcccgatagatgacccgagcgtggtggtactgacgcccgggcgcttcaacagtgcgtttttcgaacacgcgtttcttgcccgggaaatgggcgtggaactggtcgaaggcgcggatctgttcgtgcgtgacgacaaagtcttcatgcgcaccaccgacgggccgaaagcggtggacgtgatctaccgccggctcgacgacgcattcctcgacccgctggcgttcaacccggactcgatgctcggcgtgccggggctgttgtcgtcctatcgctccggcaatgtggtactggccaatgccatcggcaccggcgtggcggacgacaagtcggtctatccgtttgtcaccgacatgatccggttttatctcgacgaagaaccgattctgaaaaacgtgccgacctggcaatgccgcaacccgtctgaactttcccacgtgctggccaatcttccagatctggtggtcaaggaaacccagggttccggcggttacggaatgctggtggggccggcgtcgacgaaggcggaaatcgacgccttccgcgagcgcatcaaggccaagccgcacgcgtacatcgcgcaaccaacgctgtcactgtcgacctgtccgacctttgtcgaaaacggcatcgcgccgcgccatatcgacctgcgcccgtttgtcttgtccgggcgcgaaacccgtgtggtgcctggtggtttgacccgtgtggcgctgcgtgagggctccctggtggtgaactcatcacagggcggcggaaccaaggacacctgggtggtcgaggattgaaggaagcttgccatgttaagtagaactgcctcggatctgtattggatgtcgcgttacctggagcgggcggaaaatctcgcgcggatgctcgacatcagttattcgctgtcactgatgccgcaggacggtcgcggcgatggccttcacgaactggccatgccgctgctgatcaccggcaccctggatgattatctggagcgtcacggcgcgctgcatgctgaacgcctgttgcacttttttgccctcgacgcggccaatccggcgagcatctacagctgcctcggcgccgcgcgggccagtgcgcatgcagtgcgtgggcgcatcaccgcggacatgtgggagaacatcaacgcgacgtggctggagattcgcgggatcgccgagcagggcctgagtcgctacggcatgagccgtttctgcgagtggatcaaggagcgttcgcacctgttccgtggtgcgtcctacggcacgatcatgcgtaacgatgcgtttcgcttcatccgcctcggtacgtttatcgagcgcgcggacaacacgctgcgactgctcgatgcacgttatgaaatggccggcgatcaagccgaagcggtcagcgatggcacggcccacgcgtattaccagtggagtgcgctgttacgtgcactgtcgtcattcgaggcctacaccgaaatctaccgtgatgcgccaggcgcccgtcacgtcgccgagttgctgctgttacgtgccgatgttccgcgttcgctgagggcctgcaccgaagagatcgaccagatcctcgcgcagttgcccggcgccaacggtcgccccgcgcagcgtctggcggcagaaatggacgcacgtctgcgctacaccggcatcaacgaaatcctcgaagaaggcctgcacgcctggctgactgaattcatcccgctggtgcgccaattgggcaacgccattcatagttcctacctggaggctgcatgagactttccataagccacgagaccacctatcactacgaagatcaggtgcgggcgagcatccagtacctgcggctgacaccccacgacagcgagcgtcaacacgtgctgagctggcagctcgacctgccgcgtccggtgcgcgcgcagctcgatccgttcggcaacatcctgcacgtgctgaccatggatgaaccgcacgaagcgatcatcattggcgcgcgcggtcaggtcgatatcgacgaattgcgtgaggccgagcatgagagccagtcggcgctgccgttcctgcgctttacccgcttgaccgaggccgatgaagcgctgcgatcgttcgccgaaaaatcctgcaagcagcgacgggatcgcacggcgctgattgatttgatgcacggcttgaatcagcacatgacgtatacgccgggctccaccgaagtcgacaccagcgccgctgaagctttcgccgggcgtgccggggtttgtcaggatcacgctcacgcgtttctggcttgtgcacgtagtctcgggattccgtcgcgttacgtgtcgggatacttgtacagcgaggattgcgaacatctcgccagccacgcctgggcagaagcgtggctggatgacgcctggtacagctttgacgtgaccaatgaactggcgcggccggagcggcatttgaaactggcggtgggcctggattatctggatgcctgtccggtacgcggcatgcgccggggcggcgggtgtgagcagatgcacgcgaaagtgttcgtctcgccgaccccgatcatctccgtccaacaacagtaacgggttcacacaaaacctttgtaggagtgagcctgctcgcgatagcggtctgacagttgaattatcagtgtctgacactccgctatcgcgagcaggctcactcctacaaggaaatgtgctcagggcttaaccttgcgcccggccatatgctgcaaatacccgatcaacatctgcaaatccccctccggcaacacctctaccgaaaaccccggcatcttcgcctgcggccactgacgcaaactctgcggatcacgaatgtagcgcttcaagaaatccaccccgaaatactcagtcgggctatacggaatattcaaatccggcccgaactgggcatcccccgcaccgttcaaacggtgacacgccagacaattcttctgaaacagcgcaaaccctagatttaccggatcatccgccttcagcgcaggatccggcaacagggcagggaagcgctcagccaccggcgccatgcgcttgatgctcgccacttcgaacggccattgctcggggctgatattgccggcttgcgggtcagtccacaccagatagaacggcccggcgctgtgcttgccttcggacaacggcggccacggctgggctgggtcttcgattgccagccaggctcgcgagccttggctgttgagtagcggcgcagcggccagttctgcggcgaagccgtccagcgccaccgcttgcaggtgatcgtcgggtctgattccggtgagcagcgcggccatgggcacggcgcgataggtcatgtccttcttgtaggacacatcgtttttaatcgtgagggtttgcacctgaggatgcttgagcaattcctcggtctgccaggtgcggctgtttgcgcccaactgcaattgcagctgggcggcagacaagggcatgctcagcagcatggccgcgaacacaatgagcgctttcaaatgatcgccgtccatgtcgtgggagtgcgcaaaggttggcacagccacgctggcccgggtagcgggccagtcatattttcagtggcgatagatagcacctgccgctcgattcagccgattaccttggtcaaattcggcaaaatcaacaacagcgtcgtggcgaaaagaatgagccctgcttgacgaactttcggttgtttgaacatggcttgaccgcctttattgttatttcctgatgcctgcctgcatatccatgacggcaagcgctgcacttcctgttgaagaacgccggcctcggcaaaacccgacgactctgacgtacaagtactaccttagggcccgcgtcacgcttggcttagatccatttcatatggagccgttgtcatttgcgattaaaaaggcatgaggcgtattgccagcttctttgccgcccgcttgctagacaactcgccgacctgaaccggttcacccaaggcatgatgaccgtccgtctgagcgtgcgggtcaagcgcattgagcgctgtggtcattgaatcaatggctgctcggggcaagagtggagccacaggaaatcactcaccgtactggttcgaggacgtcatgacccaagctttgatattcgatgcgttacgcacgccgcgcggcaaaggcaaggccgatggtgccctgcacagtgtcaaaccggtgaacctggttgccggtttactgaccgcactgcaagcgcgcaccgcgctggacaccagtcaggtcgatgacgtggtccttggttgcgtcacgccgattggcgatcagggctccgatatcgccaaaaccgccgtgcaagtggccgactgggacgtcagcgtggccggcgtacaaatcaaccgcttctgcgcctcggggctggaagcggtgaacctcggcgcgatgaaagtgcgctccggtttcgaagacctggtggtggttggcggcgtcgagtcgatgtcgcgggtaccgatgggcagcgatggcggcgcctgggcgctggatccgcagaccaacctgcacagccacttcaccccgcagggtgtcggtgcggatttgatcgctacactcgaaggcttcagccgcgaggatgtcgatgcctacgcgctgcattcgcaacagaaagccgcacgggcgcgggccgatggttcgttcaacaaatccctggtgccagtgcaggatcagaacggcatcattctgctcgatcacgatgagttcattcgtgccgaatcgacgcttgagggcttgggcaagctcaagccgagttttgaaatgatcggccagatgggcttcgacgcaaccgcgctgcgggtctacagccacgtcgaacggatcaatcacgtgcatacgccgggcaacagttccgggattgtcgacggtgcggcgctgatgctgatcggttccgaagccaagggccgcgcgctgggcctgcaacctcgggcgcgaattgtcgccacggcagtcaccagcaccgatccgaccatcatgctcaccggccctgcgcctgccacgcgcaaagcgctggccaaggctggcctgcgcgtggaagacatcgacctgttcgaagtcaacgaagcgtttgcctcggtggtgttgaagttcatcaaggacatggccgttgacccgcagaaggtcaacgtcaacggcggctccatcgccatgggccacccgctgggcgccaccggttgcgcgatcctcggcaccttgctcgatgaactggacgcgcggcgcctgcgctatggcctggcgacgctgtgcgtcggcggcggcatgggcattgccaccatcatcgaacgcctctgagccccgtattcaaggaaccttgttatgagcgaagccattcgttacgaaaaaggccaggacgctatcgtcgtgctgaccatcgacatgccgggccagagcgccaacaccatgaacgccgtgtaccgcgaggccatggccgggtgtgtcgcccggctggtcgccgaaaaagacactattgctggtgtgatcattacgtcagcgaaaaaaaccttctttgccggcggcgacctcaatgaactgatcaaggtcggcaagccgcaagccaaagccttctacgacatggtactgaccctgaaaggtcagttgcgcactctggaaaccctcggcaaaccggtggtcgcggcgatcaacggcgcagcactgggtggcgggtgggaaatctgtctcgcctgtcatcaccgcgtggctttggatgatgcagcggtgcagctcggtctgccggaagtgacccttggcttgttgccgggcggcggcggggtggtgcgcatggtgcgcatgctcggcatcgagaaagcgctgccatatctgctcgaaggcaagaaggtccgtccgcagcaggcgatgcaggctggtttgatcgatgagctggcggcggatcgcgatgaactgctggccaaggctcgcgcctggattgttgccaatccggcagcggtacaacgttgggatgtgaagggctatcagcttcctggcggcacgccgtcgaacccgaaagtcgcgcaaatgctggcgattgcgccgtcgatcctgcgtagcaagacccaaggcacgatgcccgcgccggagaagattctgtgtgcggcggttgagggcgctcaggtcgatttcgacaccgcgcacttgatcgaaacccgttatttcaccgaactgaccaccgggcagatttcaaaaaacctgattggcacgttctggtttcagctcaacgagatcaacgccggtggctcgcggccacagggttttgcgccgtataaaacgcagaaggtcggcgtgctcggtgccgggatgatgggcgccgggatcgctttcgtcagtgcttcggccggtatcgatgtggtgctcaaggacatcaacctggcggcggccgagaaaggcaaagcccattcggcggcattgctggacaagaaagtcgctcgcggccagatgacagtctcacagcgtgagactgtgctggcacggatcaaaccctgcgagaacgatgcggatctggccgggtgcgatctgatcatcgaagcggtgttcgaggatcgcgaactcaaggccaaggttgcttctgctgcccagcaggttgtcggcgcgcaagcggtcatcgcttcaaacacctcgacactgccgatcactggattggcgactgctgtgccggatcaaagcaaattcatcggtctgcacttcttcagcccagtggaaaaaatgcccctggtggaaatcatcaaaggcgcgcagaccagcgatgaaaccctcgcgcgcggcttcgatttcgtcctgcaaatcaaaaagaccccgatcgtggtcaacgacagtcgcggcttctttacctcacgcgtattcggcaccttcaccaatgaaggcatcgcgatgctcggcgaaggcgtgagcgcgccgatgatcgagaccgaagcgcgcaaggccgggatgccggtcgggcctctggcgatctctgacgaagtttccctcagtctgatgagccatatccgcaagcaaacggccaaggacctacaggcggaagggaaacccctgattgagcacccggctttcgccgtgattgacttgctgctcaacgaatacaagcgtccgggcaaggccgcaggtggcggtttctatgattatccggcgggaggccagaagcatttgtggccggaactgaaggcgcgtttcgagagggccgacgggcaaatctcgccgaaggatgtgcgtgatcgtttgctgtttatacaagccatcgaaaccgtgcgctgcgtggaggagggcgtgttgacctcgacggcggacgccaacgtcggctcaatcttcggtatcggtttcgccgcgtggactggcggtgcgctgcaattcatcaatcagtatggggtgaaggatttcgtcgcccgggcgcagtatctggccgagcagtatggcgagcgcttcacaccgccggcgctgctgctggataaagccgcaaaaggtgaaatgttctaaggggagcggggagcgagcacttcggggcttgccttgccagggtgtttcaaggcaggctctggggtgttcattattcccatcacgtgtcaggtattttttatgtcgctacgcatctgcattctggaaaccgacatcctgcgtccggaactggtcgatcaatatcagggttacgggcagatgtttcagcgcctgttctcgcagcagccgatcgccgccgagttcaccgtctacaacgtgatgcaaggcgaatacccgagcgacgatcaaaccttcgatgcgtacctggtcaccggcagcaaggccgattcgttcggcaccgatccgtggatccagacactcaaggaatacctgctgaaccgttacgagcgcggcgacaagctgctcggcgtgtgcttcggtcatcaattgctggcattgctgctgggtggcaagagcgagcgtgcgactcagggctggggcgtcggcactcacaattacaaactggctgccaaggcgccgtggatgagcccggtgcgtgaagaactgacgctgttgatcagtcatcaggatcaggtcactgcgctgccggaaaacgctacggtcattgcttcgagcgatttctgcccgtttgcggcgtatcacatcaacgatcaggtgctgtgcttccagggacacccggaattcatccacgattactcccgggccttgctggatttgcgtcaggaagcgctgggttcgcagatttacagcaaaggtgtcgcgagcctggagcaggagcatcacggcgccacggttgcagagtggatgatgcggtttgtggcgcataagccagaaactgtttaaagctagaagcttcgcgagcaggctcgctcccacattagattttcggtgcgccaccgatcaatgtgggagcgagcctgctcgcgaatgttccagacaactcggtctgctctacaaccaccccgacttcttgaaactcgcccacaaactcacacaccccaccgtaataaaccccagcacaccgaaatagccgtaatgccaactcagctccggcatgttctggaagttcatcccgtaaatccccgccaccgccgtcggaaacgccagaatcgccgcccaggcagcgaacttgcgctgcaccacgctctggcgtgacgcctcaagcagcacaccaatttcgatggtctggctggcaatgtcggccaaggtgctcaggtcttccatctgccgtgtcacgtggatctgcacgtcgcgaaagtacgggcgcatgttcttgtcgataaacgggaagctcagcttctgcaattcctcgccaatctcaaccatcggtgccgcgtaccggcgcaggcgcacaacgtcgcggcgcaaaccgtgcagcttctgaatgtcacgctcgtttaatgcgctacacagcacgttacgctccagctcatcaatctcggcatggatcgcttcaccgaccggctgataattctcgataacgaaatccagcagcgcatacagtacgaaatcttccccatgctccagcaacagcggacgcgcctcacaccgttggcggacatgggcgtaggacgccgagtggccattgcgcgccgtaatgatgtagcccttgccagcgaagatgtgcgtttcaatgaactgcaggacgccgttttcacggatgggcgagtaggtgacgataaacaaagcgtcgccaaaggtttccagctttggccgactgtgtttttccagcgcatcctcgatggccagttcgtgcaagttgaactgacgttgcaggttggacagctcgcgcgcgtcgggctcttccaggccgatccagacaaagtggccggtttttgcggcccaggccgcgccttcatcaagggaaatattggtgactttcttaccttcgctgtacaccgcagcagcaacaactcgacccatggtggtgattcacttcttcttggcagatggcagggaatgcaaggcttcagcttagccgtgtcgctgcttgagagtcagtgaaatctgcacagttcagcgggcaaaagaaaacccgcacagggcgggtttcattttcaggcagcttgcaactgccgatccatcgattcgatgcactcgcgcatctgctcgcggcactgatcgatgagcatgggcatgtcgtccatcgtcaatccggcggtaggaatggccggcagcgagcgtatgaggattttcccactgcgccagcgattcaagtgcatatgtttgatgtagctgctgacacataccggaacgatcggcacgccagcggcaatcgccatctggaacgcgcctttcttgaacggcaacagctcttcgccgagattgcgtgtgccttcggggaacacccagatcgaggtgtcttcgttctgcagagtgttggttgtcgtgagcatggactgccgtgccttttgcgcattaccccggtcgatcaacacattgcccgccagccagaacagttggccgaacagcggcacccacttcaggctcttcttgccgatacacacagtacgacggggcacgacgttgccgaacacgaacagatcgtagttggactgatggttggcgatgatcacgcagctgtcaggcttgttcatcaggccgctgacatccgttttcacccgcaggcgcaaaatgcacatggctggcaatgcgtagaggcgggcgcacaaacggctgttgtccggattgaacgggcggcagatcccgaggatcaccccgagtacgcctgccagaataaagtgcaggcccatcaataacatacgaaacacgaacagcattttcaggccccaccgggacaaaaggtggcgcagtgtacggatgtgcactgttttcggcaattgccgctatagagtgcggagataggcgatgtttaagcgcatgtttccaagcggctcgtcagtgccgtcctagagccgctacagcgattttcaatcgagcgtgcaagaaaaagcccgacacgatggtcgggctgttcttcgccgcagagttttggggattaacccagatgctcctgatcctgaacgatcgcattgtccagggtttccagcagcgctttgcgcaccttcagcttggtgttcttgtgcgcgagcatgttgatcttcttcagctgacgtgcggcagccagagcggcgccttgcaactcctcggcggaaaccaccttgtcaaggaagccggcatccacggcgctttgcggatcgaacatctcgccattgatcaccgagcggtgaaacgccgaacgacgcagacgatcacgggccagctcaataccggcgtggtgcatggtcatgccgatctgcacttcgttcagaccgatgctgaacgggccatcgacgccgatgcggtaatcggcggacagcaggatgaaagcgcctttggccacggcatggcccgggcaagcgacaattaccgggaacgggtgagagagcaggcgacgcgccagagtcgaaccggcagtcaccagcgccaccgcttctttagggccggcggtcatcactttcaggtcatagccgccggacagaattcccggctgaccggtaatgatcacgatggcacgatcagtcaccgcctgatccagcgccgcgttaaacgccgcaatcacgtccggggaaatggcattgaccttgccattgctcagggtcagggtcgcgataccgtcttcgaggtggtaggaaatcaactcactcatgacgctattccttgtaagaaagatgggcagacgttacccaccgacgccagccaggtaaagcgccgtgactgacccgccagtcaccgttttcagccccgcccggcgcagcacgccattctccttctatatagaagaggcgccattaccaaagattggccggtttgccatggcccgtccgcggccaaaaccactttttcgcttaaccgcatgaaaattctgaaaaaaagtttgccatcggaaaagctttcgactacattagcgcgcctcgacagacagaacatgtttgaagagatacggtgaagtgtccgagtggcttaaggagcacgcctggaaagtgtgtatacaggaaactgtatcgagagttcgaatctctccttcaccgccacattcagtacacaaaacccctgatttcgaaagaagtcaggggttttgtggtttctggcgtctggattttattggctgcgcagtgatgtctgctgtgaccgattacaatcgcgggcttatttttcagtaaagggacgacatgccatgatcatttccaccactcacgcgattgaaggccgtcagatcactgcgtacctggacatcgtcagcgcggaatcggtgcagggcgtcaatgtgattcgcgatatgttcgccggtatgcgcgactttttcggtggccgttcgcagaccctggagcgggctttaaaggaagctcgcgttcaggcgacggaagaactccgcgagcgagcccaggctctgcaggcagatgcggtggtcggggtggatttcgagatcagcatgcctggcggcaaaggcggaatggttgtggtatttgcgaccggcacggcggtgaagttgcgctgatttgctatcaggcctgtgagcccattcagaatcgaatgggctgttttggttggcgctcagccctgcggcttgaggatcacaagccctttattgtcataggtcagcggtgtgtcgatagcgacaagcgcaggcgtgtcggagggttgacccggctgcaccggctggctcggatggtaaatgacgccaggctgtagaaccggtgtatccggacctggttgtttgatggttatttcaccggaagcgatcttgtccttgagtttttccgccccggttttgccggctgcgatttgttcgtccgtgagctttacgacgggcaggtttgaaaatccgttgatttgcatgttctctccttgagattcatttgtgtgaaaaagggcaacggcctgtcggtggaattctttagccctgtgggatcaatggcccatgtccgtgtttaattttcctaggccattcgtcgggcatcagcggatctgaataacaagtccaggaatgaccgactagtctcaaaagcctgggaggtcgatatttttcaggcagaaaggttttgccggtgtcgacctgtggcgaagaggcgaaggtatgactgatccgtatatcgaagacgatggcgctgaattttccttcaacaattgcgtgcggtgcggccagaccgaataccaggcaggctttggtgaggatccagtgctgaccggcaagatcaaatcgacgccaccgaagggaccgaaagcgaaatttctgccgaaggttaccgtgagagccagaaagtaagcatttggcgaacaaccccgtctttgagcggggttttttgtgtctgacgaatggattgggaagcgtcctacaggtgatcgagctgttgctggttttttttcacaaacttttcacgtcgggcaaagtagggtgaagccatccgttagaaagcaagtctccagcccgtctccccagcgggcttttttttgcctgtcataaaacctttcgcagaatcgctgtccaatcggcgccgagtgcgcgcgagcctgtgcttgcgtctggacttttgtgcgccgagcgcattaaatcccggcccattttgtcatcccattttttgaggtttttgtcatgcgtttaactctgcctgctctggttctagggcttctggttgctcaaggtgcattggctgccggcgatggcacggctgcgctgggcggtggcctgggtggcgcgttgggtaatgtgctcggtcagaaaatgggcggcagcaccggtgccgcagtgggtgccggcgtcgcgggcgcggcgggcagcgcactggcggcgcgcaagggaagccgtaccaaagcggccatcggcggtggtgtcggtgcggcgggtggttcggtgattggcaacagcctcggcggcaagaccggcgcgaccattggtgctggcctcggcggtgcagccggcggcgcagtcggcagcaacctgtccaaaggccacaagcgtcactgagactgatcgtctcgcagaaacagcccggctcgatgccgggctttttcgttgctgaacgtttttcccaaaggtgcctccaatctcacataggcccttgtttgggcggactgtcccgattcgggaactgtgaggttcatatgcgattgtcattatctgcactgtttttcggattgctggtggcgcaaggcgctatggctgccggagatggctcggcagccgtcggaggtggactcggcggcgtgctgggcaacgtggtcggcggacagttgggcggtagcaccggcgcggcggtcggtgccggggtgggtggcgcggctggcagtgcggtcggggcgaataaacataatcgcaccgaagcggccattggcggtggcctcggcgccgcaggtggctcagtggtcggcaatagcttgggcggatcaaccggttcggcggtcggcgcaggattgggcggcgcggcgggtggtgcggttggcaataacttgggtgacgatggtgggtcgcactcgggtggcggccacaagcacaagaacaaacataaaaaccgccatcattgatggaggtttgaacagaaacccggctctttgccgggttttttgtatttgctcgtcagacactggaacgattggctgtagggcttttcgaacgtcatacacgccacgagatgatgaggtttgctatgactcccgaaaccgaaggcaaggaagaaaaaggcccgagtgggctgccgtttatcaatgacccgggaaatgaagatccggggtcgttgatggatgatgcgacggtgccgttgaatgattcggatgaggcggatatggagtatgaagaggatgaggatgagcagtgaacggttgttactcaggctgaactcgctgatggactgaacctaactctgctgggcctgtgatttcaggccctgagaggtgtgcatgctagttagtgaggttttcgttcagcttcctttcgatgtgacgtagccatacatcgccggatgcccattcattccagtaacagtagtaacaatgcagttcttttaagaagaacgtccgcaggtccatttcgtttatatgcatgctgatcagggtttgcagttcgcgatggaccgaaaccaatacatctttatctgagcttctcaaaaagtcattgatgacttgatctgctgtgtcgtgctccgcaagccagtcttgatgaaaataagagccaaaaaagtcctgagtttctggaaagtcgttattcatagctctggaaatcccgttagtaaaaaatatcccaaaggtagggtcggatcttttttcaacactaatagcagttttgttgctgattgggattgagaatggccattgagcatactcacacccaccggtcgacttagatcgtgtgtgaaattcgtttttgctttattgctgttcaaaaaattttttattttttgcgcattcgccactaaagcttctgatactgctacttcagcttctgcgcgattcaagaaagtggatgcagcgggaatgttaggctccgcttgtagcctttgagctagctgagattcagttcttccgatgtgcttaataatcagatggccaccctgcgcctcatgagccgctaatccaccccccggcactatctcactatagggcccatcagcttgtattgctcccggacatggattacaagccaaccccaacggatccacccaccccgtcggattcggcacgtactggtactgattcggctcactcctacatttggaatgcattcccctgtaggagtgagcctgctcgcgatggggccagtccaagcaccggaaattatttaggcccgagaatcttcgccaacttgtccggcgaaggcgcaccttgctgctgttgcagctcgcccttgtcatccatatagaagatcgccggtgtcgcctgcaaatcgaggtcttccatcaactgcatgttcgccgccagtttgctctgcaccgccaccggaatatctttcaaggccttgagcgtgctgcccttgccagccttttcatgatcttccagggccttggccggatccttcgcagcgagcaacgccgctgacttgcccgggctgtcctcgcggatgatcccgaccatgatgtgccgcagctgcaccttgccggatttcacccacggccgcgcctgttcccagaacatgttgcagtaagggcagttcggatcgctgaacaggtacacggtgcgcggtgcatccttgttgccgtcctgaatccagttgctcgcctcgaacttggcccagacttccttggccatcggcgcatacaccagtttttgcagcggttcgctgctcaggtccttgccgtcggcgtcgtatagattaccgagcagaacgtgtttgccatccggggtcaggtacagcgccatgccacggttctgatattgcgctgcgtaaccgcgcaggccatcgggggcgtcgaactggccgacgattttcgcgcctttggcttcgatctgcttgatcgccgcaggcaactcttcagcagcctgcaccgacggcaaatgcagcagggcggtgcccagagtcagcgtcagcaggtggcggaggcggggcatggcagtttccttgcagaggtggccggagcagtggccggggtcgaattcggggtcggggtgtcgaagttttccagcgcgcgcgccaggctggcgttggacagctcgccaagatgactggccagcagacgcccgtcggggctgtagaacagcgtagtcggcaatgccatggaacctacggcctgaccgagctggccgcgacgatcgaacagcacgttgttcaaactcaggccctgggtttcgagaaacgtcgccacgctttgcatgctttcggcctgattgacgaacaggaaggtcaggtccgggcgttgttgctgggcgctttccagcactggcatttcgcgtcggcacggtgggcaccaggtcgcccacaggttgatcaccagcgggccgccctgataatcgctgagctgaatggtttcgccggcggcgttgcgcagggaaatatccggcaggcgtgtgccctgttcgtagatattcaatgacaaggtcgccaataaccagaacaccacgccactggccacgccaaagcccagcggacggcgcagaccgggccgacgccagccgcgatagaacgccgccagcagcagaacgatcaccccaggccaggcgagaaaaccgccgtcgcgcagatcgacgatctgccacggatcgttgcggtaatggctccagtacagcgcgacaaaggcgatgcgcgccgccagcatgccgagcagaaacaggctgaataacgccgactcgggattatcgccgccgcgcttggccacccgccagccgacaaaggtcgccagcgccaatgcactgatcagcagcaggtggttgagcgcgatggcaaaggtgccgagggtgaaagtcagcattaattggcgtctcgggtggtggcccagcgttgcaggaacgtgtcggcatcgacttcgccggtgatgcgctggctgcgacgctcttcgccgtcggtgccgatccagatgaacgtcggcggtcccggcactttgtaacggctgagcagctcgcggctggcggcattgtcggcggtgacatcaagcctgagcaggcgcacatcgctcaatgcctgcatgaccttgtccttgccgaacacctgtttttccatgactttgcacgacacgcaccagtcggcgtaatagtcgagcaagacccattggcctttggttttcgctgtatccagttcgcgttgcagggcgtcgggattgttgattgtggtgaacgcttcatggccattgggtgcagcgctggtcgtgcgaccggcgctataaacctgcaacggctggtacggatcatcactgccacccgccgcgccgatcaccagcaaactgccccacaaacccagcagcagcgccattgcgccgaacatctgtgcaacacggccaaagccttcggattgtttccaggcactgtaagcggcaatcaacaacagcgcgccgcacaagcccagccacaacgacgggtccagcaccggccgcaacatcagtaacgcagtggcgagaaagaggaaaccaaacacgcccttgagcaggttcatccactcgccgggtttgggcaggaagcgattgccgacggtcaccagcaacaacagcggcacaccaataccgatgcccagcgagaacagaatcaagccaccgtgcagggcattgccactctgcgcgatgtacaacagcgcgccggccagcggcgcggtcatgcacgggccgaccagcaagcccgacagcgcgccgagcacgccggcgccgaccaggctgccaccactgcgactgcgcgaagcgtgttccagacgatcacgcagcgccaccggcaattgcagctcgaagaaaccgaacatcggcaacgccagcaccacgaagatcgcggcgaacgtgccaagcagccaagggttctgcaaccacgcttgcaggttcgcgccgagcagcgcggcaatcacgcccatcgccgcatacaccagcgccatgcaaatcacataactgccggccagcgcaaaaccgcgacgcggtgtggcaccactgccgacgaccataccggcgagaatcggcagcatcggcagcgtgcaaggggtgaacgccagcagcaggccgaggccgaagaacaccagcagactccagcccagtgcgcgctgttgcaggctgctggccaaggcctggtccggtgcttcggtgcctgccgcgacggcggctttaccgccgaggtcaatcactcgggtttgcggcggatagcacaggccggcatcggcacagccctgatagctgaccttgatctggccgctggccgaggcggggattttgacttccaggccttggcggtaaactggttgctcaccgaaaaactcatcgctgtgcgattcgccttcgggcaatgccggttgttgttcggcgctcagaccgtcgaatttcagacgtttctgatacaggtaatagccatcagtgatttgccagaacagctgggtttcacccgattccagacgctcggacgtgagcacgaacgctttatcgaccggcagaaactccggttttgactcaaatgggttgtttccagcctgggccaggctcgaaatcagcagagcaaacaaaagaaaaaaatgacgcatggaggagccttgtccctgtgcaagtgaggtgcacaatgggcggtggcgattaaccgatgattaaccgccatgcccttgtcgctgtgacgttcggggcataatgtcagcttaatcggccaactgcctaatcggcttttttctacgggactcaccatgcacgtactggtttgcgaagacgatgagttgatcgccagcgggatcgttgccggtctcacggcgcaggggttgaccgtcgagcacgtcaacacggcgtcaaaggcacgggcgatgctcaaggttgccgaattcgacgtgatggtgcttgatctcggcctgcccgatgaagatggcctcaaattgctccaacaactgcggcaaagcggcctcgaaatcccggtactgatcctgactgcacgtgactcggtcactgaccgcgtcgacggtttgcaggccggggcagacgattacctgcttaaacccttcgatctgcgggagctgttcgcacggctgcaaaccctgttgcggcgtgtggccgggcgcagcgtcaatctgatcgaacatggcgcgttgacctacgacccgagcagccgcgaaaccaccctcgccgggcaaccggtggacttgtcgcgccgtgagcagtcgctgctgcaagcgctgctgcacaaccgtggtcgtgtactgtccaccgagcagttgaaagacagcgtctatggcttcaacgacgaactggaaagcaacgcgctgaacgtgcacatccatcacctgcgcagcaagcttggtaaaggcatcgtcgaaaccgtgcgcggtctgggctaccgcctcggcccggccgacggtggggatcaaggcaagtgatgagtctgcgattgcgtttgagtctgaccctcggcgcagccttcgcgctgatctgggcactggcggcggcctggatgctcagcgacttgcgcaatcagatgatgttctcgctggaccagcgcctggtcgcttcggcgcgcatggtcgccgggttgctggagcagttgccgacattgccgagcaagggcgagggcacccatttcagtgccgaacagttgaacattccgggtggcatggcctgtcaggtcagctccttgcgcggggaaattctcgcgcgcagccacaacaatcccgagcaagcactggaagccgagaaaatgggcttccacgaccagatgatcgatggtgcgccgtggcgcagctttaccctcgcgcgcggcgacgtacgcataaccacggcggatcgacagatcgaacgcgaagcgctgaacatgtcgatcctgctggcggcgtcggtgccagtcggtgtggcgctgttgggttgcctgtgcctgttgtggttgggaatcggacagggcctggcgccgctcaatcgtctgcgtgaggcgttgatgcggcgtaacgccgattcgctcgaaccgttgcagctgcagtcgtttcccagtgagctgaagccactgctggaaacgcagaatcagttgttccagcgcatcggtaaaaccatcgaacgcgaacgtcgccttaccggtgatgccgcccatgaactgcgcagcccgctgaccgcgatcaagacccacctgcaagtggcacgcatgaccgaaggcagcgctcgcgatcaatcgctggcgcgggcggaggagggcgctgatcgcttgcatcgcacgctggagcaattgctgttgctggcgcgtgtcgaaggcagtctgtcgttcgacgacggttcgcaatgcagcgccgaacaggtcgcccgactggcgattcaggacgcaactggcggcgaacgactgcggatcaaactgcaattgcctgcgcaactttctgaggctccgttgcaaatgccagcggtgttggcgattgccgcgctgcgcaatttgctcgacaacgcgctgcgccatacgccggaagattgtgcggtcgaggtgagcctggagaccatcggcaatcgcgtacggtttgtcgtacgcgaccatggtccaggcattgccccggatgatttgcagcacctgacccagcgcttctggcgcaacggccaaagcacaggctgcggcctcggcctggcgattgtccaggcgatcgtccagcgttgtgactgcgcgctgcatttcgacagccgacctgacggtttacgcgtcgaactgaccatgcctctgcaaacgctctgatttcactcctacaggggattctcatcaaatgtaacttcttggcgttcgctatccgggcagggcggggttaaggtcggcctctgctttgactcaacggattgagagaacagcgcaatggatgctcccgtctatatttacgccgccacacccgccgactccggcatcatcggccgtatcatcgaacgctcgattcgcgtcggttgcgcgcttgatcaccgtaacgacccgcgcctcgtcaatacctggatacgtcagcaatcggcagagcgcatcaatgcgtggctgctcgatccgcatttctatctcaacatcgcattgttatcggacaaaccggtcggcgtcggcatggcggccgccagtggtgatgtgaccttctgccatgtgcaaccggaatggtttcgccgaggggccggtcgggcgctgatggcggatctcgaaggctggttgcgaatccgtggcaggcccagcgtggccttgaaaagtacacgcaccggcgaagcgttttatcggcatctgggttatcacgcgtcggcaccggccttgctccatcacggcgtaaaagccacgcccatgcacaagtcgttggcggttcctgcctgacatctcgatcaagggtctaaatcctcgccgcgcttaagcgtttccagaacaggaaaacctgcaagtgcgctccgcgaccggaatgcgcacctgtgcggtgtgctgttttggtcacaatccatagcgaattgaggggtcgagagatgtcagtcgccaccagccttatcgaagagtcgtcggcccgggtcagctcggcgccagcggaaacgttgtatcagttcactgaatcgccgttactggctcggcagagccagcaggaatccaacgctcgcagttatccgcgacgtattccgctggcactcaagcgggccaaggggctgtatgtcgaggacgtcgaagggcgtaccttcatcgactgcctggccggtgctggcacactggcgttggggcataaccatccagtggtgatcgaagcgatccagcaggtgctcgccgacgaactgccgctgcacacgctggacctgactacgccggtcaaggatcagtttgtccaggatctgttcggcttgttgccacgcgagctggcggcgcaagccaaaatccagttctgcggccctaccggtaccgacgccgtggaggctgcgctgaaactggtgcgcaccgccaccggccgcagcaccgtgctgtcgttttccggcggttatcacggcatgagccagggcgcgttgagcctgatgggcagcctggggccgaaaaagccattgggtgccctgctcagcagcggcgtgcaattcatgccgttcccgtacgactaccgttgcccgttcggcctcggtggcgctgccggcgtcaaagccaatttgagctacctggaaaacctgctcaacgatcccgaggccggcgtgcaactgcccgcggcggtgatcgttgaagcggtgcagggcgagggcggggtgattcccgccgatatcgagtggttgcgcggtttgcgccggatcaccgagaaggcgggagtcgcgctgatcgtcgatgagatccagagcggtttcgcccgcaccggcaagatgtttgcctttgagcacgccgacatcatcccggatgtggtggtgctgtccaaagccattggcggcagcctgccgctggcggtggtggtctatcgcgactggctcgacacctggcaaccgggtgcgcacgccggcaccttccgtggcaaccagatggccatggctgccgggtcggcggtgatgcgttatctggtcgaacacaaggtctgcgaacacgccgccgccatgggggcacgcctcagcgaacacctgcatattctgcagcgcgacttcccgcaactcggcgatattcgtggccgtggcttgatgctcggtgtcgagctggtcgatccggccggtacgccggatgcgctgggtcatccgccagcgttcgcgcgtctggcaccgctggtgcagcgcgaatgcctcaagcgtggactgattctggagctgggcggtcgccatggtgcggtggtgcgtttcctgccgccactggtgatcaccgccgccgagatcgaccgcgttgccgagatcttcggtcgcgccctgattgctgcgactgccgcgctgtaaattttccgccgcgccgaacgttctttctacatacccggccgcacccgttgtgcggctcacccatacaacgatggagaaccagcatgacgtcagtattcgaccgcgaggacatcctctttcaggtcgtggtcaaccacgaagagcaatactcgatctggcctgactacaaagccgtgccggaaggctggcgtaccgtgggcaagagcggcctgaaaaaggaatgcctggcctacatcgaagagacctggactgacatgcgtccactgagcctgcgccagaagatggaaggccaggctgccgcgcaataagcggccgggcaaaaagaaacccgctggactggtgacagtcagcgggttttttcttgccttggatttgtgtagtccgggctggcctctcgcgagcaggctcactcctacagggggagcgcattccaaatgcaggagtgagcctgctcgcgatgaacgataacgcggtttcagctgaaattaagccccgctcaaacccttcaatagcaaatccacattgccttccagctccgccaccggatccgccgcatcggtactgagcaccaccagacgactgcccgactcggcaatcgccgctttcactgcgtccgatggctgccgatgatgcagcaccactgctacatcattgtccttgagcgttgccgtcagttttttcagatcctcagccgtccactccgcatcaggccgtggatcctggccaaccagctccagattgaggctgccgatcagatagccgaagtgatcgctgagactcatcacactgaggttgtcggcgctggctaatcgcgcctcgctgtcggcgctgagcttcaacaaacgctgcttcaacgttgccagattagcctcgatcgcaggcttggcactcggtgccaggcgcgtcagatctgccgccatgacatcggccatgcgccccatgttgttgctcgccagccatggctggctgttcaggccatcgactttcaaatccggttgcacggcaatgccgggcagggcgccgtcgaccgggcgtgccgcatcgacttcgacaatacggatattgctgcgacgggcgatcgggtacagctgatcatccggccacaacgagcgcacgccaatcacggcatcggccgcggttgccagtttgctcagtgccggggcgccacgccccgtgaaataggcgctctgacgactgcccggcaggttcgctggcgccgctcgttcgagattgacatcagtgcctttgagcagcgcctcagccaagccaaaggtgatgggcaaagaggccagcacccgcaactgtttagtgttttcggcggccatcaatggggtgcaaaccacgccgcacaaggccatggccaaggtcagcttacgcagtgaaaaagtcatttatccaagattccctttcagactcgggacaaccccgcgcgcaatggcggcgagggcgaaagcgataccagcgaccagaatgatcgcggcgccggacgggatcggcaggtcgaacacgatgggcgcgagaatgccgcacaaggtgctgacggtggcgatcagcaccgaacaccagaaaaagcccttgagcgattgactgagcaagcgtgcggcggcagccggaatcaccagcagcgcgccgaccagaatcgcaccaatcacttttaccgccgccacggtgatcagcgtcaccagaatcacgaacagataatccagggttttcaccgccacgccgcgcacggccgccagttgcggattgaaactggcgagcatgatgcggttgtacagcggcagggccagggccatgaccagcgaaccgacgatggccaataccgccagatcgttgccgttgaccgtcagcaccgaaccgaacagcacgttctcgagaatgtgcacattgatcttgcccgccaggatcagcagcagactcgcgccgagtgccagcgacaccgacaggaatacgccgatcaaagtgtccggcgccagaccggtacggttacgcaggtaattgagcaggatgccgaacagcaggcaataaccgaacaggctgccgtacggtccggtgtagggttcgccgagcagaatgccgatggccacgccggtcagcgcggcgtgaccgaccgcttcggagaaaaacgcgaagcgcttgaccaccaccagcgtaccgagaccacccagcaccgggccgatcaacaaaccggcgagcagtgcattgaccacaaaaccgtaggccagcgcttccggcaggtaaccggatgaggcccagccttgcaccatcaaacgaaaggcttcgtaactcatcaggcagcgctccgtggatgggtcgaaaacagggtcagcagacgttccggagtcagcgcctgttgcggcgtggcgtcgaacaggacgcggcggttgaggccggtgacgtgattggccagacgcccgaccgcttccagatcgtgttcgatccacagcacggtgatgcccgcggcgcgccagtcattgagcaggcgctcgaagacctgaatgccggcctcgtcgagcgccgacatcggctcgtcaagcaccagcagttgcggtgcagggatcagaccctgtgcgagcagaacccgctgacgttcacccccggacaacgcgcccatgcgccgcttgcgcttgtcctgcatgccaacgcgttccagtgcatcgccgatcgcgccggcgtagcgcttgctcaagccaagaaacgccgggcgacgctggcacatcgcggccatgaaatcgtcgacggtcatcggtaaaccacgatcgaactccagcgcctgcggcacatatccgatggtgccgggggcgccgggccattgcaggctgagctggccctgatgtggcatctgccccagcagcgtcttgatcagcgagctcttgccgccaccgttcgggccgaccagcgcatgcacgctgccgggctgcacctggaaggtgacgttgtccaaaatcgtcgtgcgccccagcgtcagacaaacctccgcaaagtccaaagtcggtccttgtgggagcgacggtgcgacgattcgacctgctcgcgaatgcgctgtgtcattcaatacagatgttggctgatctggcgccttcgcgagcaagctcgctcccacaggggattcgagttcgttcgaaatcgtttctttggaggtcatgcgcccgactcctgaatcgcccgcaccacggtattgaggttgccggtcatttccttttcgtatttgtcggcggtgtattcaccataggaaatgtgtgacagcgggtacagcttcacgccggactcacgctggatggtttcgacgtaggtggacgggaagtccatctccgagaaaatcactttcacatccagttcgcgcagttgatcgatagtctttttcaactggctcgggcttggctcgatcccgtgcgccggctcgaccaccgccgtcacttccagaccgaattcgcgcaacagatagtcataggccgcgtgaaccgtagccacgcgcagttcggcgttcggtgcctgagtcagtttggccagggcgtcggcacgcatctgtcgcaggcgtttgccgtaggcgcgggcgttctgggtataggtcttggcgttgtccggatcaagcttgcccagttcgcgggcaatgttgttgacctgcgcgatggaggcgctgatcgacaggaacgtgtgcgggttgaccactttgccggcgccgcgtgcggcaaccccggtggcggccagcagcggcacgttttcattggcttcgatggttttgatgttcggtgtttcgctggcggcaatcatgcggtcggcgaaatcgtcatggccgacaccgttgagcacgatcacatccagcccgctgatgcgtttgatgtcctcggcgcgcggctcgtaggcgtgcgggttgaaaccggcaggaatcagcggcaccacctcggccttgtcgccgacgatgtttgccacatagctgtaataagggtgcagggtaatgccgatacgcaggcgtttggcgctatcggcactggccagcgggctcagcaggcaggcgcagaggccgaccagaaacaggcgtaacaaaggacggcgcggcgatgaaatagacatgggcaagcggtcttctctcggataggggcgaggaatcaatggcgatgttcgcgggtaaccccggcatcgtattgcgcgacgatctgtttccagccggcagcggacagagcgtcggcggtgagttgtgcgggggcttgaacggctgcatcacggttgagccagatgtccggcgccgccttgtcgtcggcactgagcagcatcacgaacgaacccgcgacggcaggggtctggctttggccgaaatacgcggcgtccgccaacaactgccaggcatgaccgccgcggctgaccgagctggcgtcctgagcaaacggcgcaaacccttcgtccgcgaggttctgcggcgtcggcagggcttgctgctcttcgcgcagcaagcggatttcgtcgagggtcacccgcaggtcggcgtagatgccttgctccgaagcactgaggtcgcggcgtgcgtcgagttgatttgtcgcgaccggctccggctcatgggaaaccccgcgccatgcgacgaccgaaccggcaatcgccagaatcaacagacacaacagcagcacattgagggtttcatggccggcacccgccgggcgcacaacttggctggttggtgtactcatggggtctcgatatccgcttggtcgatttcgaccacatggcctggacctgcgtcgaacagcacataaaactcggcgccaggcttcttgaatgtcagtgtcgagtcggcaccgagcttgcccggcaccagaatggtttcgtcgtagccgatcacatcgagggtcacccccggtgcgccgctgccgtcggagaaaccgccggtgcatttgatctgttcggcatcgatggccttgcattcgcacatcgggttgtgggcgagggcgctggcactgaagccggcgctcagcaccagcagcgcggcgctcaggcgcagacgggaagggcggcgagcgtggctcatggtttggctccttgtttggtcagccatgcaatcgtggcgggagaggcctggctcaggggaatagaggcttggtgcatgctgccgtcccagccttccatggtgatccacagttcggcgtcgggtttggtcttttccgggatcagcaattgcgtgcccatgcggtacggtgtgccgaagaagatcaccccggcggcgcgcaggctgcggggtttgccgatgcgcaggtaagtggccttgacctgttcgatacaggcgtcacacaacgcagcgttgaagtccttcgagtaaccggcgggaccattgagcggcgcgtcgttgcgcaactcggcaaggcgcaggctccaagggccgacctggacgtcaccgatctcgcgctcgccaaggccgctgtcgccacggaacaacgccacatcggcaaagtatttcggcatgaaacccagcggaatcagcagcagcagtacattgatatggaagcgccatttatgccagaagcggctcaggcgtgaaggttgggcaatgctcgtcgtctggctcacaggctggcctccgaagtctcgcgggtggtcgcgggctgcacggcggcggtgcgggctttcttgctttcgcgtttaagggcgttggcggtcgccagcgcggtgcgcttggtccagatcaacaaaccgctgagcaccatcatgctcagcaacaggccgaagaagaaccagatcagcttgatccacagaccaccgaagtcaccggtatgtagcgggcgcatggattcggtgacgaactccagtgacgtgcgatccgacagcacgcgggaggatgccagctcgccgttgaacgggttgagcgtcgcgctctggaacatcagtggataccagcctcggccacgaatatcgaggtgactgtaggcattgaaaggcatgttgatgacgctggcctcgagcccgggaatcttttgctgggcgatttcgatcgcgcgatcaaggctgagccgggccggtggcaggccatcggcggtcaacggcacgctgtcgcgcgacatggccggaatgatcgcctcgctggaaatcgatatgtggttatcggacagcaccgcttcaatcaggaaccaggtgctggtgacggagatgaccgcaatgaaccagattgaccagatgccgctcagacgatggaagtccccccagaaaattcgcgcaccgtggcgaatgcgcagggtcggactgaaaaaacctttccagaaacgcttgtacaccaccagaccggtgatcaacgacgccagcagcggcaagctcagcgctgacaccagataccagccccagctgtaaccattggtgaacggcaccagccaccagccatgcaaggcacgggtaaaggcctggaaattgaattccggcgccgtgccctggatcacgcccgtatacgggttgacgtaggtgaccagcgagcgcccgtcgggatagctgagggtgacatccagcgcgaaatgcgattcgtcggggcggctgatgcgttgtaccagtgcctgcggttcagcggtcttgatcgctgtgatgatctgttcataaccgagacggggtgcatcgtccgacggctggctggcgcgcatctgcgggttggccagccagacgatttcctgactgaccaccgccaatgtgccggtgacacagacgatcagcacgaaaaaccagatcggtaacgccagccagctatgaacgaggaaccacagtttggagcgggatttcttcgacatgattgcgcgtcttgtattcggtgaaagggcgcgtggctacgggcttcgcagcacgggatccccgaaaagccgctcgtggcttttgcctacgcgaacggcctgcatctatataagacgaatgagcgctgcaaatcccgaaaggggatatgaaagcaaatgtttcgcaattccccgatcaccacacgtccccttgctcaagaacgcggacgatcagttaacgcggacgtgactgacacaccgctttcgcgagcaagctcgctcccacagggttttgtcgtgttttgaggatcgaacacgattcatgcatgacgccatcactgtcaggcaattgatggcccgccggcgctccctatcatggagctcacgatgaatgcctgagtgagcaccttgatgaccgccagaaccctctatgacaaacacatcgattcgcacacggtgtgccgcctcgacgatcagggccatgtcctgctctatatcgatcgtcaggtgatcaacgaatacaccagtccccaggcattcagcggtttgcgcgaggccgggcggggtgtctggcgtccggaaacagcgttggcggtggttgaccacgtcaatccaaccacaccgctgcgggtggccgcgatgccggatgccggtggcgcgcgacaggtgtcgtatctggcagagaattgccgggacttcggtatcgagttgctggatatcctcgacaaacgccaaggcatcgaacatgtgatcgcgccggagcagggttttattttgccgggcatggtcattgctgccggcgacagccacaccacgacgtatggcgcgctcggcgctttcggtttcggcatcggcacctcggaaatcgaacacctgctggcctcgcagaccctggtctacaaacgtctgaaaagcatgcgcgtgacggttgacggcgagttggcagcggggctgacgtcgaaagacctgatcatggcgctgatcggccagattggcgcgtccggggccaccggttatgccatcgagttctgcggttcgaccattgatgccctgagcgtcgaggcgcgcatgaccatctgcaacatggcggtcgaggccggtgcgcgtggcgcgttcatggcgccggacgacaaggtgttcgcctatctcaagggcaaaccccgcgcgcccaccggcgacttgtgggagcgcggactgcaacaatggtgcgacctgcgcagcgatcccggcgccttgttcgaccgcgagattcatctcgacgcccatctgctggaaccgatggtcacctggggcaccagcccggatcaggctgcaccgattggcgctcgggtgcccgatccgcaagcgatcaacgacccgatcctgcgtcaggacatgcgccgcgccctcaactacatgggcctcgaagccggcatgccgctcagcgagatcgtcatcagccatgcctttatcggttcctgcaccaacgcacggatcgaggacttgcgcgatgccgcccgtgtcgtgcgcgggcagcaagtcgccgagcatgtgcgggcgatgatcgtccccggttccagcgaagtgcgcgcccaagctgaagcggaaggattggcgcggatttttatcgaggccggttttgaatggcgtcagtccggctgttcgatgtgtctggcgatgaacgacgatgtgctggcccccggcgaccgctgcgcgtccagcaccaaccgcaatttcgaggggcgtcagggcgctggcgcacgcacccatctgatgagccccgcgatggtcgccgctgctgcgatcagcggccgcctcaccgacatccgccacgttggagtacgcccatgagcctgcaacccttcactcaggtcagcgggcaggccgcgccattgttggccgccaacgtcgataccgacgtgatcatgcccaagcaatttctcaagggcatcgacaggaaaggcctggatcgcggtttgtttttcgatctgcgatttttgccggacggcacgccgaatcctcagtttgtgctgaatcagcctgcgtggcagagggctggttttcttgtggtcgggccgaatttcggctgcggctccagccgcgagcacgcggtgtgggggttgcagcagttgggcattcgcgcgctgatcggtagcagcttcgccgggatctttttcgacaactgccagcgcaacggggtgttgttgatcacgctggaggaggcgcaggtgcagcgcatcggacggcttgtcggtcagcctgaaacggcgcggatcagtattgatctggagacgcagcagattggtttggcggatggcagcgtgatcgatttccagattgatggtctgcgcaaaacttcgctgctgctgggacttgatgcaattggcagcaccttgcaacgccgcgaacaaatcaaggatttcgaacgccagcacctggtcaacaacccctggctctcctgacccaccgctggcctccttgtaggagtgagcctgctcgcgatggcggtggatcagtcagagttgctgtgtctgacacaccgctatcgcgagcaggctcactcctacagggggttgcggtgttctggttacagcgacaggcttttgaaatgcgcctgcaaaaactccacacatgcgcgcaacttccccgaatgcgccagccgtgtggggtacaccgcccagacattcgcgctctggctgtaatcttccagcacttgcaccaaacggccttgctcgagcaacggcttcacatcccacaatgagcgcagcaataccccacgaccatccagcgcccattgcaaaacaatctcgccgttgttggacgacaatggcccgctgacccgcacgttctcttggccgccatcgcgatccagattccagatgccgaaggcattgtcgcgctccttgatcaccaggcaatcgtgctgctgcaggtcgtccagcgtttgcggcgtaccgcgacgttgcagataacttggcgccgcgcacagcacgcgccgattgctgaccagacgccggccgatgtgctggccgggaatgtcatcgccaacgcgtatctccaggtcgaagccttcgttgatgatgtccacgacgcggtcaaacaggtcgaggcgaatctccagttgcggataacgttcggccagcaacgacacggctggggcgacgtgattgcggccaaacccgaaactgctgcagatgtgcaaacgcccacgcgggctgtcgtgggcgtcggagagttcgtcgtgcagttgctggaaatcatcgagaatgcgcaacgcccagcgctgtacccgctcgccatcctcggtcagcgagacgcggcggctggtgcggtgcagcaggcgtgtgccgagggtggtttcgagaatctgaatgcgtttgctgacgtatgccggggacaggcccagttcatccgctgcggcagcaaagccgttcttgcggatcacggtgagcagcacccgcaggtcttcgggcagaggcaaggtgtctttcttctggggcatgtcgaaacgagcactggcggcagaagccgccagcatagcatcgggatccgcagccctggtcagcgcagaaaggccagtgcttcggcaagcaacaattcagggacttcttcggcaatatagtggccggcgggcagggcttgcccgctgacattcttcgccacctgctgccattctttcagcggatcgaaacagcgcccaaccgtgccttccgcgccccacaagacccgcagcggcagattcagatgatgctgggcggcgatgtcggtgcggtcgtgctccagatcgatgccggcgctggcccggtagtcttcgcagataccgcgcgcgctgcccggctgttgcaggcagcgccggtattcgtcgaaggcttgctcggtaaatggtttgagcccggcgcttcgactgcccatcacgctgcgcagataggcatcgggattggcctcgatcagggtttccggcagcggcgccggacgaatcaggaagaaccagtgccagtaggcgcgggcgaaggcttcgttggtttgcgtgtacatcgacagggtcggcgcgatgtcgagcaacatcatgcgctgcacggcggccgggtgatcgagcgcaaggcgatgcgccacccgtgcgccacgatcgtgggcgaggatcgagaactgcgcgaagcccagcgactgcatcagctcgacgccatcacgagccatttcacgttttgaataattgcgatgctggtcatcggcgtcagggcgaccgctgtcaccgtagccgcgcaagtcggcggcgaccaccgtgaagtgctcggccagttgttcggcaatcttgtgccagatcacgtgggtctgcgggtggccatgcagcaacagcaggcccgggccgctgccgctgaggcgataggcaatgtcgacgccgttgacgtgacgctggtctttgaggaatccggcaaacatcagactgatccttttttcagggttcttgttggatgcatcctgaaattgtctggcgttcggggcaaggcgcaaagcgtgatgggccgcttcatgaagtgtgatgtgtatgtttgtaaaggcgctatcgcgagcaggctcactcctacaattgaaatgcattcccccgtaggagtgagcgtgctcgcgatagcgcctttacaaacattacaaaacctaaccctgctgaaacatctccatagcccgctgcctgatttgctcttgggtcagatcctctttgcgtgaggccagaaaccacagatgtccatagggatctttcaacgtgccgctgcgatcaccgtaaaactgatccttgacctcggacacggtggtcgccccggcatccagcgcccgctgaaaggatttgtcgacatcggtcacgtacagatgcaaaccgaccgacaccgcgttgtccggattgctcaacggcccttggtcgcacggcgagccgagcatgattgcgctgtcaccaatgcgcagttcggcgtggccgataccgccgtcgggcatcgccaggcgcatgacttcggtggcaccaaacgctttcttatagaagtcgatcgcctcggcggccttgtgaatgccgagatacggggtaatgctgtgatacccctcgggaatgggtttgacgctcatgacgttctccctgattgttgttttgcgaggtgaagaaacactatagaactgtccacgcagtgcagatttttgcccgacgagcagcaggggcgcatctctcctgtggtaaggggataaattccctcgccacggggccttcattaatccttggtgaagtgtggcccgggcccctgttcgccgagcacgtcgccctgattgcgcaacgggcacgcttccatcgacagacagccacagccgatacagccattgagtcggtcacgcaacagcgtcaattgctcgatccgctcatccagttcgcgtcgccattgctcggatagcaccttccagtccgccgctgtcggtgcgcgatcatccggcagaattttcagcgcctcgccaatctctgccagtggaatccccaagcgctgcgcgactttgatcaacgccacccggcgcagcactgcgcgcgcatagcggcgctgattgccggcattgcgctggctcttgatcaaacctttggcttcgtaaaaatgcagcgccgtcaccgccacaccgctgcgcgccgcgacttcaccgaccgtaagctgcttgtgcaggttttctcgggtgatcattggaaaagactcttgaccttgacttaactagaggttttaccctgcaggccttcgagtcgcaagactcgtcttacgatgagtgggggcgttccatgaacaaccatagtttcacccaattgatcgaatttgaaatcgaaccgcgtcagcaaccggccctggtcactgctctttcagtgcaaagcgaacgtctggcccagcgctacgacggtttcctcagcgccagcgtgcaggccagcgatgatggtcggcgggtgttgagttttctgcaatggcaaacccgcgaggcgggggaggcagcttttcgcagttttgaaagtggcgaacaggatttctggcaactgatccacattcatcgggcgaaaaccgtcaccttcaattccttccaggtgctgagcagcatcgcccgcagtcacgacgatgccttgcactgcaatctggtcggttagatcgatagctggataagccgctcgccgtgcaggttttcgctcagtcgccgcttgttcaccgccagttcgccgatcttgatcagccgcgtacgtgtgacattgcggctcaggccaagcagcgcggcggtgtgcacctggttgtaatggcagaagcggtaagcggcgcgcagcaaggcgtcttcaactttttcgtgtaatgctccggcctgttgcgcgaacagtttttgaaaggcctgttccagcaaggcttccggtgaatcatcggcgccggcatgatcgtcggggcgctcgatgcgcatgttcgacaggcgcagatcatcacgctcgatcacgccattgcggcagatcagcagggtgtgatggatgacgttttccagctcgcgaatattgcctggccaactgtaggcgcgcagtttctgctcggcgcccggactgatgctgacgcggccatagcccaggcgctggctgtaagcctcgatgaagtggcgggtcagcggcagaatgtcgccggggcgttcacgcaacgggctcagttccagattgaccacgttcaggcggtaatacagatcctcgcgaaaatgcccggcattgatggctttttccagttgtacgttggtcgcggccaacacccgcacatcgatggggatgcttttgcgcgaaccgagccgcaccacttcacgctcctgcaggacccgcaacagcttcacctgaatcgcgatcggcagatcaccgatctcatcgagaaatagcgtgccgccatccgcctcctcgaaccagccagccttggcgctcagcgcaccggtgaacgcgcctttttcatggccgaacaattccgcctccaccagcgattcggaaaacgcgccgcagttgaccgcgataaacggccggtggcggcgattgctcaggttgtgaatatgtcgtgcgaccagttccttgccagtgccggtctcgccgatgaccagcacactggcttcgctcggcgcgacctgttgcaaatgcgcgagcagcgcttgagatttcgggtcttcgaacacttgcgcggtggcgcggatcgacgtcgcgagcgcgggtgagggcggtaaggtcagcaattgcatgggctcgtcctttcaaggagcaatcaggaatagaacgtcggcaccggcagcgcctgattcagcgcccagtcgcccagctcatggagtttgtaatcaagtgggtcgtgcaaggtttgcgtgcgcaggttgcgccagtggcgatccaggcgcagtgaggcgtgagtggcgcgcgccccggtgacttcgaacaaacggctgcaaatgtccaggccctgacggctggccgcgacttttgccgtggcaatcgccgtggcgacatgaccgcgttcttccgcgctgaggttcgggcctttggcccacgcttcatcaagcaaagccgccgcacgttcgaccagtaggcgaatgccttcaagggcgacccagaattcgccgaaatgcgcgagcacatacggatcctcctgcacagtacgggctgtggatttgtgccagagacgggtttcattgagggtgtattgccgcgcttcctcgaatgcaccttcggcaatcccgaggaacatatgcgtgaacgtcagttgcgcgatcagcgggcgcaagcaggcgaatggcgtgctcagtgggcccggatcgaggagcaattccgattcttcaacccgcacccgctcgaacgtggcgctgccactgtcggtctggcgctgaccgatgttgttccagtcgttgtgcagggtaatgccgctgcggccactggggatcgccgcgatcaagagcttgccgccggcgctttcatcgaccgccgaggcgatcagcatttgtgagtcgctggcgccggagcagaaactcttcttcccggaaaattcgcgccagccaccgagatccttgaccaccgtgcgggtgtcgagcgggttgagcgcgttgccccagaaccagttttgccgtgcggtctgttcgaaccacggctgccattgttccgggcgggagaacaggcgcacggtggccagcatcaggtgatgaaagccgaaaacgtgggcgatcgagctgtcgaccttggcgaactcgcgcaccacttgcagggtttcgctccagctcgcgccgaggccgccgtaacggctggggatgctcagggccagcaagccgctgtcgcgcagggcatcgcgttcggccttgggcgtgccgccgcgttcgtcgcgctcaatggcggtcagggcaaactccgcagccagttggcgggcgctctgcaatggcgataaaagggtactttgcggtttggcagtcacaccaacactcctgaattcaatctgcccctgcgcggggtgggttatgccgtggcttttgtcggcaggacgtcgttggcgatcatttcgccgaacggtccggtgaggttggtcaagccgcgcccggccaggctcgcgtaaggctcgggcagcagcggaaaaaccagctcggcaaagcggtaagcctcttccagatgcgggtagccggagaagatgaaactctcgatcccgagatcggcgtactccttgatccgcgccgccacttgctgcggatcgccgaccaatgccgtgccggcaccgccgcgcaccaggccgacgccggcccacagattgggggcgatttgcaggttgtcgcgccggccatcgtggagcgcggccatgcgccgctgaccttcggagtcgaagcgggaaaaggatttctgcgccgcttcgatggtttcgtcgctgatgtgttcgatcagtttgtctgcggctttccacgcctcttcggcggtctcgcgcacgatcacatgcaggcgaataccgaacttcactttgcgcccatgccgtgccgcgcgttcgcgcacatcggccagtttctcggcgacggcggccggtggttcgccccaggtcagatagacgtcgacctgctcggcggcgagatcatgcgcagcgtcggaggagccgccgaagtacaacggtggataaggtttctgtacgggtgggtaaagcgctttggcgttctgcaccttcaggtgtttgccgtcgaagtccacggcctcgccttgcagcacccggcgccagattttcagaaactcatcagtgacttcgtagcgttcactatggctgaggaagctgccgtcgccccggttttcgtccgggtcgccgcccgtcacaacgttgatcaacaggcggccgttggacagacggtcgagtgtcgcggccatgcgcgccgacactgtcggtgaaatgatccccggacggatcgccaccagatagcgcaggcgttcggtcaacggcaccagcgccgaagcaatcacccacgagtcctcgcaagatcgcccggtgggaatcagcacaccgtggtaaccgaggctgtcggccgcctgcgcgacttgtttcaaatagttgagcgtgaccggacgcgcgccttgagtggtgcccagatagtgcccgtcgccatgggtcggcagaaaccagaaaacatccatgaacagctcctcaggcgattttcagcaacggtttgatttgcgtggcgaatagcggcgcagcgcgttccgcagccagacggatacgtgctttcaaggtttcgctggtgatctggtagttggcgaaatcagcctcggtggcgtatacgccgatcggtaaagtgacggcctgaaagaagctgaacagcggtcgcaactgatgatcgagcaccaacgcatggcgttcgctgccaccggtggcggccagcaataccggcgtatcgatcagtgcgttgagatcgatcaggtcgaacagatgcttgagcaaccccgggtaggagccgcgatagaccggcgcggcaacgatcagcaggtcggcctgttcgatggctcgcaactcggcttcgacttcagcgctcagttcctgacgcgagagcgcgccgccgagcggacgggcgatgtcaccgagttcgatcaggtgactctcgatcggcagatgcccggccagctcagccagcaaggcttgagtcagcaccaaggtgcgggagggacgccaggtgccaccggagagggcgacgactttcaggggacgcgacatgatcagttcctttttcaacagttgctcagcgagcagtgagtaagtcactgggctggagcaagtgctgtaccaattcccgcagagcccgttttaccgggcattgagcgttccgctggcgaccggttgtgtgaatatcgacgctgtttgctgaaccgctgttggctgagcaacagttgctggagccacagcgatgagtgcatgaagggatttatataggttgtttgttattcctcaaaagaacgtaaattgatatttatagatctttaagagatatgaagctgtcgtgtcgaattcctgatagccactattgagagcgttgatttctgcacgagcgtggccgggcgtagcctttctccatcgaccctcacattgctcgccaggacgctcccatgaaccatctactgactgtttcgctgctgctcgctgtctctgtactggccggatgcgccagccacgttgctccggaattgcgtccttacagcgccgaggaatctcgcgagctggcgatggaagcgctgaaccgcagcggtttgtccttcgatgaataccactcgaaaaaagctcaactgctcggtcagccacagcagacttacggtttcgacaagcagggtgagatgagtgccgagcgtgccgtacagctgcacggtcgctccagctgaaaaccaactgtaccgcttgaagttttgctcaactgtccgtgggtttgccgggctgcgtgggatagggtcaacacctggatgaccctgacggactgccgcaccatgaacctctcgcttgatctgctgctgggctttgccctgtttgcgcttgtcacctccattacaccggggccgaacaacaccatgctgttggcctcgggggtcaacttcggttttaaccgcaccatcccgcacatgctcggcatcacctgcggtttcttcgtgcttgtggtggcggtgggtttcggcctgggcgcggtgttccagacgtatccgctgctgtatacggtcctgcgctacgtcggcgctgcttatctgctgtacctggcgtggaaaatcgctcactcgggacctgtcggtgacagcgtggagggcgaagccaagccgatcagttacctcggcgcggcggcgtttcagtgggtcaatccgaaagcctggatcatggccatcggtgccatcagcacgtacacgccgatgcagggctatttcaccaatgtcgtggtgatcgctgcggtgttcgccatcatcaacctgccgagcgttggcgtctgggccgcttgcggcacgctgttgcgtaatgtgttgaaggcgccgcgctggttgcgcgtattcaactggggcatggcggcgctactggtgatttcgctgtacccgttacttctcgaaagctttagctgacgcatagcttcaaccaccggcccgatgcctgttaagctcgacttcaggagcgttcctacgcacttttaaatgaagttgttcttctttaacggcatccgatcaggtattgatgacgctctcgaaccgacgcgctgctcacgaggcagcgccgagccgtttgcagacacgagcctcctgatcccggaacacgctctgcgagtcttttatgaacacacgtccgttgtatttcgattacgccgccactaccccggtggacgagcgggtcatccaggtgatgatcgaatgtctggggtttcacggtaacttcggtaacccggcttccagctcccacgccttcggccagcaggcccggcacacggtcgagcaggcccgtcgacaggttgccgaactggtgggtgctcaggccgaacagattgtctggacttccggtgcaaccgagtccaacaacctcgccctcaagggcgtggcccaggcacgcgctgtctctggcggccacatcatcaccagtcagatcgaacacaaagccatcctcgataccgctcgccaattgcaggacgcgggtattgccgtgacctatctggttccggacgccgatggcttgatcaccccgcaagcggtcagcgccgcaatgcgcgacgacacctttctggtgtcgctgatgcttgtcaacaatgagttgggcacggtcaacgatattcaggccattggcgccctggtgcgcgggcgcgaagcactgttccatgtcgatgcggctcagggcgccggcaaagtagcgatcgaccttgcgcagttgccggtcgatctgatgtctttctcggcacacaaactctacggtcccaaaggtatcggcgcgttgtacgtcggtccgcgcgcgcaccagcgcctgcaggcgcagattcacggtggcggtcacgaaggtggcttgcgctcggggacattggcgactcaccagattgccggcatgggggcggcgtttgccttggcggcggccgcgttcgaggaggagaaaaagtccatcgcggccctgcgcgagcgcttgcttgagcaactgttgagcgtgccgggcgttcgtctgaatggcagcgtagcgcaacgcattgcgcataccctgagcctgacgttcagcgagggcgaattcaacagtaccgcgctcagtcattcaattgccttctccgcgacgtcggcctgtaattccgccagcaacacgccgtcccatgtgctgttggcgctcgggcacgatgcgcatctggccagccgcaccatccgtttgagtctcggccgctttaccaccgccgaagacgtcgacaaggctgtcgaactgatcaagaccgcctgcgccagtgctccggcattctgggcgaccgggctttaaacgagccgaatctacggctacgaacaataacgaagaagtgattagcaggagacatgatgagtacccagacctcgaccgaaggatcggtgccccagcgcctggcgcacacccgagaactgatgcgccgcgaaggcattcatgccttgctggtgccgtccgccgacccgcatttgtcagaatatctgccgggttactggcaggggcggcaatggctgtcggggttccatggctccgtcggtactttgattgtcaccgctgatttcgccggtgtctgggccgacagtcgttactgggagcaggcgagcaaggaactcaagggcagcggcatcgagctggtcaaattgcagccgggtcagccgaatccgctcgactggctggccgagcagaccccgcaaggtggtgtcgtcgccgttgatggcgcggtgatggcggtggcttcggcacgcacgttaagcagcaagcttgaagcgcgcggtgcacgtctgcggaccgacatcgatctgttgcaggaagtctggagcgatcgcccgagcctgccgaacgcagcgatctatcaacatctgccgccgcaagcgaccgtcagccgtggcgagaaactcgccaaactgcgcgaaaccctgcaggagcgcggcgccgactggcacttcatcgccaccctcgatgacatcgcctggttgttcaacctgcgtggcggtgacgtgtcgttcaacccggtgtttgtttcgtttgccttgatcaatcaacagcaggccacgctgttcgtcgcactgagcaaggttgatgctgatttgcgtgctgtgctcgaacaggatggcgtgacgctgcgcgattacagtgaagtggctgaggcgctgcgtgccgtgccgggtggcgcgagcttgctggtggatcctgcgcgggtcaccagcggtttgctggataacctcgatggcggtgtgaaactgctcgagggcttgaacccgaccacgttggccaagtcgcaaaaaagcgcggctgatgcgcaacacatccgcaaagcgatggaacaggacggcgcagcgttgtgcgaattcttcgcctggctggaatcggcctgggggcgcgaacgcatcaccgaactgaccatcgatgaaaaactcacggctgcccgtgagcgtcgtccggattatgtatcgctgagcttcaacaccattgccgcgttcaacgccaatggcgcgatgccgcactatcacgctaccgaggaagaacacgcggtgatcgagggcgacggtttgttgctgatcgactcgggtggtcaatacctcggcggcacaaccgacatcacgcggatggtcccggtggggacgccgactgaagagcagaagcgcgactgcacgcgcgtgctcaagggtgtgattgcgctgtcccgggcgcacttcccgaaaggcattctgtcgccgctgctggatgctattgcccgtgcgccaatctgggcagatagcgttgattacggtcacggcaccggccatggcgtcgggtatttccttaacgtgcacgagggcccgcaggtgattgcctatcaggctgcgccggcgccgcagactgcaatgcagccggggatgatcacctcgatcgaaccgggcacttaccgtccgggccgttggggcgtacgtatcgaaaacctggcgatgaaccgcgaggcaggcagcagcgaatttggcgagttcctcaagttcgaaaccctgacgctgtgcccgatcgacacgcgttgtctgctgccgtcactgctgagtcaggaagagaagcagtggttcaacgcctatcacgccgaagtacgcgaacgcttgagcccgctgcttgatggcgccgcgctggactggctcgaaacccgcactgcagcaatctgatctgttgttgtgcaatgccagggcgactctttcgagcgtcaccctggcagccagtgattcgaggtttagcgcaaggcttcctcgataaaatcgagccgatcctgaccgaagaacaattgcccggcaacaaacatgctcggtgcgccgaaaacgccgcgtttaatggcggcttcggtgttgtccttgagtgcggctttgacggcatcgtcgttggtcaatgccagcacagcatctggatcaaaaccgtgttcagtcagcaccgccgcaacggttgccggttcatcgaggctgcgaccgtcgacccaaagtgccttgaacaggcaatcgatgaatgccgggaaacgttgcggatggcgcagttgcatgccagtcacggcgcgcatcagcatcagtgtattgatcgggaagtgcgggttgaatttcagcgggacgccgtagcgtttggcgtagcggtccagatcctcaaacatgtagcggcccttggccggaatcatcgcgggtgaagcgttgcccgtggctttgaaaacaccaccgagcagcatcgggatgtagatcagctcactgtcgttttcagcgcagatacctggcagttgggtataagccagatacgtcgcggggctgcccagatcaaagtagaactcaacggttttgctcatgctcgcggctctctgtttattgttatgggaacgggcttaccagcgttcattccatgggcgcagatccagctcgaatgtccacgcgtcccttggctggctgtgcagataccagtagttttcggcgatatgctcggggttgagaataccgtcctgatccttggtggcgtatttgtcgggaaagctgtcacggatgaagtcagtgtcgattgcgccgtcgactaccacatgagcgacgtggatattcatgggccccaattcccgagccatgctttgcgccagcgcacggataccgtgtttggccccggcgaatgccgcaaatcctgacgcgccgcgtagaccggcagtggcgccagtgaacaatatcgtgccgcgctggcgagtgaccatgcgtttggctacttcgcgggcattgagaaaaccggagaagcaggccatctcccaaatcttgaagtatttgcgcgcggtctcttcgagaatactgcagggcacattggcgccgatattgaaaacaaatgcctcaatcgggccgaggcgggtttcgatatcctcgatcagggcaatgacgtcctcttccttgcgcgcatcgcaggcaaagccataagcctcgccgccttcggccttgatcgcgtctaccagcggctggagtttgtcggcgctgcggcgagtgacgcaggcgacaaaaccttcgcgggcaaaacgcttggcaattgcaccgcccgtggcatctccagcaccgaccaccagtacgaccttgttgttattcatggtgaatccttttgcttaacgatcgtttagttaacgaacgttatgctaggatccggataacgtcaaggcggtgaattacagggtcaacacatgcgttattcggccggtcacaagttggaaacccgcgaacgattgctgcagagcagttcgttgtcggcaaagcgctcggggttttccacggtaggggtggatgggctgatgaaagccatcgggctgagtggagcagctttttacagccacttttcctcaaaggatgctttgttttctgccatcgtcgaacgtgagctaggtcaaagccttgagcgacttggcgggcaaggcaatgaagatcgcgagcggtttgagcgttgtctcaagcaatacctgagcatggctcatgtcgagcagcctgaggcggggtgtgcgttgccgacattgggggcggagattgcccgctcggatgtgctggtgcgcgagcaggcagaaatctggatctgccgtcttcaggagagctgggcgcagatattgcgaagcgatagtctggcgtgggcgatactttcgcaatgcgtcggcgctttggtagttgcgcggatgttggcgacaccggacgtacagcgtacggtgttgaaatccagtcacgaagagatcgcccgtcagctcgcggttcagcgagcggagtagggcggagggtcatttgcagatgacgatcatgctgcggcttgtgtagccggcggggttgagaccgaacggataatcgcccggctcttccacggcatcgccggatttggcgatgaccttgtaaccttttggcgcgcacgaattcgcggcactggcatagcacttgtcccaggaggacgagagtcctgaacagttgatatgcaaccccttcttgccgcgtttgacctgagtttccgaagtcgcagcacaacccgcgatcgccagtacggcgatcagtatcaaaattcgtttcattaccgtccttaatagcggccgcgagtctgatgctcgggtctgcctgtgttcgctcgcttctgcagcgtttctacgtccctttgcgaaaaaatccatgtctggcgatgggttacgggatctaaacatggcctaaatgaacgccaattaccagaccccggtcaaatcctgtttcaatctgccgcgatggcgggctttgcgttgctgcccatggtcatcgttgccccgacagacgccagaataatgcacatgatcgccatccattgtgacaacgacaggtattcctggagaaaaaacagacctgaaagtgcaccaaatgccggctcgatgctcatcagtgtgccgaaggtgcgcgcgggcatccgtgtaagcgcaaccatttccagggtatagggcagtgcggtggagaggatcgcgacgccgatggcaatcggaatcagtgagggcgtcagcagtgcggcaccagcatgcacaatgccgatgggtgccacgaacagggccgcgatcattacgcccaatgccgcagtcgtcacaccgttgtctgcgccggctttctgcccgaacagaatgtacagtgcccagcaaactccagcccccaatgcataaccggcgcccaccagatcgatcccggcagttgtcgcgccggtgggaatcagcagcatcagtccggctgccgccagagcaatccagagaaagtcgatggcgcgccgtgaggcataaatggccaccgctaacggcccggtgaattccagggcgacggcaattcccagagggacggtgcgcagagacatatagaagaggaagttcatgccgcccagcgccatcccgtaaacgatcacggtacgcagggatctggctgtgagcctggcgcgccatgggcgcagcaaaatcaacatgatcacgctggcaaagatcaggcgaagggttgtggttccttgtgcacctacgaccgggaacatgctttttgccagagaggctccggactggatggatgccatggctattaatagcaggccaaccgggaacagcatggaggcaagggagcggggctggtcagtcattactaggcatcatccaaggtaggagcgggtatttttatagctgttgggcaatatactgcgcattcgctgtcgttgcgtctatatataggcagctattctgacgtttcgatagaaaattgaaattaacggttgacggcagatttgagatgtctataaacgtcgttccctacgacctgccggcaaacaaaacccgcagcaccttcaaaaccctcagctcaccgggcggcaagggctacaacgaattccggattgaagacaagaaaggcgtcgagcagatctacatccacgcccagcgcgattgggatgagaacatcgagcacgatcaaaagattcgtgtcggcaacgaacggcatgacaccgttgaagccaatacgctgagcgagttcaaggttgaagagcatcggattacccatctcgatcgcaagacggaaacgcgggtcgatgaccacctgacggtgggtgtcacccggcacctgaagatcggcacggcgcagtttgtcgaagccggaaccgaaattcactatcacgccggcgccaaggttgtggtcgaaggtggcatggagcttaccgccaaggctggcggcagttttgtgaaggttgatgccggcggagtgaccatcagcggtgccgaggtgaaaaccaactccggtggctcgcccggctcggggagtggaatcgcgatcaaactgccaatcgccttgacccccgccgatgccgatgctgccggcaaacgcctcagcgcggcaccgatcaacacgccgacgcctgcggagctgctcgcagcaccttcatccggcgccgcgcccgctgcagcgacggctgcagaaacccgactgatccaacagaatatgcaggcacaaacactggtagcggccgccaaaagcggcgtgcccttttgcgagatctgcaaccgatgagccagtttcgtcccagtctcaacgaatggttgactgccgagttctggccgcagggcacgcagcctgacgcgccgaaggtctacgccttgctggacggtgcccgcgacccacacatcgaatcgctggtgcgcagcagcggcgcggaattttcctgcctgtacgcgggcgaacttgccccgagtctgtcggccgcagcaccttatctgctgcagctcgacccgcaacagccgtatacatggcgactgttcgaggaaggctgggggcagagttggggcagcttcgtcattgcccccgcgcacgtgtcgctggacgacctgcgcagccactttcgcacgctgctgcgggtgaccgatccggatggcaaccttctggtgtttcgattctacgaccccagagtcctgcgcgtttacctgccgacctgcacagcgcaagagcgcgccgcgatgttcggcccggcgagcaagctcattgccgaaaccagtacggggaattccttgattgtttacccggcggatcccgcaggcgggccagcggcgcgagtcagtggctggccgtcggccgatgcagttggtcaatacggtctcgccccctagcggtaaaataaccatcacggagtggctgattgaaacgtctcgcctgtctactgttccccctgctcgccgcctgcagcgccggcccgctgatgtatcccgaatcaacagcaggtcgcccgacgctcctttatccgacctgccctggaccgcagacggcaatgcgtttcacaaccacatcaaacgagctgaactgggttttcctgctggttcacgtctcattgccgggaggcgagccctcgccgccgggggcgaccgtggccgaaaccgaagtacgactttccactcaactgtatatggaacattcgcctaaacgtgcgttacacacccaaggacaatccgagacagcagacaaagtgccgctgtggatcaccgcgtcatcgccgatggcaaccgtgcagttggccaacggaaaaacctatcaagtgagtatcgaacgtctgaaaaccggcttcgatccgcgcgcccctgaagtacgcgatgttcagcaccccggaagcccattaggcaaaggggatatgggcgacttcatcctgaccttgcccgagctctacctgaacggtgagaaaatcaacaccgcgccgatccatttcaagaaacgtgaagagcgctatttcccgatattcaactgttgaaggctcagaccggagaaatggtcgcgagcaagccgatcagaatggtcagtgtcagaaatccacccagaaaaaacgccattttgttcatgttgctctcctcaatgctgagcttgcggtgcaccggacgcttcgggatgaaggattgccgcgagtgaccggactacggggttattttgagccgatgactgcgccggttacagaggcagattgcactgaaaaatgcatatcagatgcacatctgatcctgtcgcagctgacgagtgaaacgaggctgcgatcttttgatcttgaaaaacaaaattcaaagatcgcagcctcgtttcactcgacagctcctacataggcttttcatagggtgatattcaggttgccatgagaaggttgccctggccgcgctttgctctagagtcttggtcaccgcgagaacaactagaaaaaaccggagtgaacatgaccgacctgcagctgcaacccaacgtcgccgaatccctgaaccgctggcaccagatgatccgcaccggcgacctcaaagccctgcccgaactgcttgaccccaacgcggtattccgctcacccatggcccacacgccttaccccggcgcgcaagtggtgtcgatgatcctcaacaccgtgttcaacgtgtttgaagacttcaaataccaccgtgaactggtaacggccgatggtctgaacgtggttctggaattcagcgccaaggttgggacaaaggagctcaaaggcatcgacatgattcgctttgatgagaatggcaagattgtcgagtttgaagtgatggtgcggccattgagcgggttgcaggccctcggcgaagaaatggggcggcgccttggtgcatacctggcaaaagcaaaaccctgaccgccgaataacctgtgcaggagctgccgaacgcggcccgagccttcggcagttcctacaggggtagatacaaagcgtgcccacaaaaaagcccactattacttatctacgattcttttcattcgcaattagcctaaatggaaaagatataaaaacctgtcagattttacaggttcacgtaacaaccaagaagactagccttggctccgaggtcgagaagtttgcctagagcgtgagctttcagcgggctgcttattcaaatagtcagggagattcagaaatggcaataaattacttttacggcgatggactcactccaagcgagaaacgacccgtcgaagagtcaggcggaaccaccaatcaactcgtaaaaaaaacagctacgcaggaacacaaattcacctgtatttgcgatctttgcaaaaaagacagaggagatagaacaggaacggcggcgatctattcacagtggtacgttacagatcctgtctacccatagaaaacaatgaaaccttccaatttcatgatgttcaagatccagtccgctccacatgacaagctcttaaccgtcgaacggataatgatggatatccaacccactccaatccgttccaggtcattcagctatcgggtccacaaaaaagcccactgaccgtcgccggttcagtgggctttgtgtgtcaggcgtctagttacagagccatgtcacgtgcagcgttttccttcggtgcttcagctttttcagctgcaggtgcggccggagctgctacctgaccgatcactggaggtgtcggcagttcgaggatcttggcggtgtaagcccactctgcagccactttggctggatcgctgttcagctgggtgccgtagcttggaacgatctggtgcagtttggcttgccattccgggctggccactttgtctttgaagactttctgcagcacgctcagcatgatcggtgcagcggtcgacgcgcctggcgatgcgcccagcaggccggcgatggagccgtcttgtgcagcgacgatttcggtgcccagtttcagcacgccgccagcggcttcatcacgcttgatgatttgcacgcgttggccggcctgccacaggcgccagtcttcggctttggcgttcgggaagtattccttcagcgcgttcatgcggtcttcatccgacagcatcagttgaccggccaggtactcgaccagcgggtattccttgatgccgaccttggtcattggccagatgttgtgggtggtggtgctggtcaacaggtccaggtacgaaccttccttgaggaacttggtgctgaaggtcgcgaatgggccaaacaggatgacgcgcttgccgtccagaacacgggtgtccaggtgcggaaccgacatcggtggcgagccaaccgaagctttaccgtaggccttggccaagtgctgttcagcgatggccgggttatcggtcaccaggaacgagccacctaccgggaagccaccgtattccttggcttcaggaatgccagacttctgcagcaggtgcagtgcaccgccgcccgcgccgatgaacacgaacttggcatcggtttcggttttggtgccgtctttcaggtttttgtagctgacgcgccaagtgccatcggcgttcttggtgatgtcctgcacttcgctcgacagtttcagatcgaagttaggcttggtctgcagatgggcagcgaactggcgggtgatttcgccgaagttcatgtcggtacccagcgggctccaggtggccgcgattttctggttcgggtcacgcccttccatcatcagcggaacccacttcttgatcacagccgggtcttcggagtactgcatgccggcgaacagcgggctcgcttgcagggcttcgtagcgctttttcaggaacttgatgttgtcatcgccccacacgaagctcatgtgcggcgtggtgttgatgaacgagcgagggttcttcagaacgccttgctgaacctgccaggcccagaactgacgggacacctggaacgcttcgttgatctcgacggctttcgggatcgttacgttgcctttgtcgtcttccggggtgtagttcagctcggccagagccgagtgaccggtaccggcgttgttccagccgttggagctttcgagggcgacgccgtcaaggcgctcgaccatttccatcgaccagcttggctccagctcattgatccacacaccgagggtggtgctcatgatgccgccgccgatcagcagaacgtcgactttctttgcttcgtcagcattggcggatgtcatccccatcgccaaagccagacccagcagggctgtgttcacttttttaaacatctgttgcacctatgataaaacgccttccgcccgccgctgttatctgcatgcgatccgctttgatgacgctcaggctagcgtcgcggattccggcacacttcaattttgacgggtgggcacacaaggccgacatcctgcatcgacctcagttaatgtcccttctgaactgacttcttatcattattggcttcagctgcttgagcgacagggattccgtcagcccgcccgaaggcaagcaaaccgaattaggtcaaaccaagttggcgcgaagaatatcacgtcagggcaaacccgcgcgtctgttcccgacttgagagtctttttccgctcaggacactatcggccgacgaaggctgaacatgacccctgaagattgaagggttgggaggaagtgcccaacgccaggatatctgctaagttgtacgatgactgacaaataaaacaactcagtcataacccataacaacaaggaaacaacttccatgaccaaaacccgactcctcatcggttttctctgcgccttcaacggctacgccatggccgcctctgccccggcagaaaaagatgtcgcccaagcggtcgatcatctgacccaggcgatgctgcacaaagacatcgccgaactgaacgcgcttaccgcgcccaacctgacttacggccactccagcggcaagattcaggacaagaaggaattcatcgccgacatcgagaccggcagaagcgccttcaagaccctcgagatgcagaagcagaccatcaccctctcaggcgataccgcgctggtgcgccaccatttttcggcgcaggcgttgaaggggaccgaggtggtgccgacggagatcgagaactttcagatctggcagaagcaggacggcaaatggttgttggtggggcggcaggcgttcaagttttgatcggggttaactgactctgaatagatgttgactgggctgccgtcttcgcgagcaggctcgctcccacaagggaacgcattccaaaggtgggagcgagcctgctcgcgaaggcggcagcccaggcactacaaatcttcctggttacaaccgaaaccgatccaccgattgcgccaactgccccgccaggctcgacagctcatcggtggtattcgccgtttgcccgatcacccggctgttgccctcggacatccccgcgatcatttccacctgatgggcaatctcgttactggcctggctctgctcgccaatcgtgcgggtgatgtcgttgaccagttgtgtcgtgctcaacgtcgcctcgaggatttcgcggatggcgcgctcgacgtccgccgtcaccgccatgcccttgtcgacctgtgcaacacctgcctccatgctgctgaccgcctcgcgggtgctgtgctgaatgcgtgcgaccatcgcggcgatttcctgggtcgaggcgctggtgcgcgccgccagactgcgcacttcgtccgcgaccaccgcaaagcccctgccctgctcgccggcacgagccgcttcaatggcggcattgagcgccagcagattggtctggtcggcaatgctcttgatcacctgaatgatgttgaaaatggcttcggattcctggtccagtgtgcggatgacctgtgccgactgttgcgccgagcgcgcgatatcgtccatgtcgctgaccacttgatgaatcaccccaccgccctctttcgccagggtttcggcttgattggccatgctcagggctcgttcggcgtgacgggtgatttcctcgatgctcgcggtcatctggctggcggcggcggccatggtgccggcggcgacgctttgttgctggctgctgtcggcaacctgatggcagccctgactgagtcgtgcgctcatgccgctgacgccgtgagcgtttcggcgcaccacgtcgatcatgttgcgcagatcgcgctgcatggtcgccaaggtgcgaatcagcgcactcgcttcatccttgccggacggctcggcgatgggttcgccgaggttgccgtgagcgatgctgtcggcgatgcggctggcggttttcagtggccccatgatgctgcgtatcacccagcgtccctccaccaatagcagcagcagaccggcaagcagcaccacaccaagcgcaatattggcattgcggatggcggcttcggtacctgcgctggtctgccgggtattggtttcgatcagttcacttaacgcagccatctgctcttcaagttggccgaatgcggtattgaacgaaccgagttcctgttgcgcggtatccggattatccagcgccaggccgacaatccgctcgcccgcattgatgtagatgtcgagactcggttttatctgctccagcgctgtacgcaatgcagcattgatcggcaatttgaggttctcatcgagcacttcgcgaaagtgccccgcgtgctcgtcaatcgactcgcgcacctcggtcgccgtgctggtgcttttgcccagcccgaccaacatggccgaatagacatcggcgcgcagggcgtcgtgcatcatgtcggcttccatgtggttgcgcagcgcgctcatgctgaccgcgttatcgctgaccgctgcagccatccgctggttgccgacgtaactgaccagactcacgatcactgccgtcagcagacttgtcacaatcagcaacactaaacgcagtttgatcgacaccggggtttcctccttggccatgcctgcaaacgcctgtcagaccttcagttaagcctatttgcgcaggtctgccgtgccagagcgtgtcagcaggtgtcggcatgagggccaaatgccgcaaaactttcgcattgagcggcaagtctcactttgcaacgcaggcgtacaacgccttcatcgccggttaatgccggcaggctattgagtccgccgttctgaacactcatgcagcaaaaggagacgcctatgaaacgcgtattgtggttgggtctgcttggcactttggccatcggcagcgcacaggcggcgacggaaaaagtcgccatcaatctggtcagcgccgacggtgcgccgcaagcgatcggctcggtcaccatcagcgaaaccgcgtatggcctgttgttcaccccggatctgaagtccctgccggccggcatccatggcttccacgtccatgagaacggcagttgcgaagccgcgatgaaggatggcgtgaaaggcgctgcactggccgctggcgggcatttcgatccacagaaaaccggcaagcatctcggcccttacgccgacggccatctgggcgacttgccagcggtttacgtgaccgctgacggcatcgccaactacccggtactggcgccgcgcctgaaaaagatcgccgagatcaagggccatgcgctgatgatccatgccggtggcgacaaccacgctgacatgcccaaaccgctgggcggtggcggtgatcgcatggcctgcggggtgatctgagccgtcgcagtctgaaggccgggcaacccgtaatcgcgttgcccgcgtctgttttgcaataacgcagactttcctgccccacggaactcccgcccgccgcgcccctctcacattatgtagtccttccctttttgcttcgcgcttgtggaggaacaccgtcatgcgcaagttagtgctcgtttcttctttactcctatgcctgcccgtgggttccgctctggccaaagtcgatgccggagatgtcgccacctcggccggtgtctccgcgtcgctgtactcgaccttcaaggatcacaaaatggtgattccggcccgtgacgacttgtctgcatttgtcgccagtggcggggccattcgtggggtttatcttgagtcggtgctgcaacaggttcgccaggacaatcctggcctgaacgccagtgatgaagatctcgccaacgcgattctggtgcattacgaaggcctgaatcagtagctgtcacggatgaagcagccgatggacggccgctgacggcgcataggcaaaactgtccgacggcctctatgatggaggccatgacgacttccgcgcctttgcgctcaccctgcccgcccggcgcctgcatttgcgggcgcgatccgttgctggagacacccggcgcggatttgcgcatcctgcgcctgacccgcgaggaggagaaagtcctgctggcgcggctggaaaaactcaaagaccttgccgatctcgaacacctgcaacaacgcatgtatgaacaactgggattgcgcgtcgaagtcgctcccggtttcaacgaagtgcgcaccatgcgcggcattgccattcagatcgaagagttgccgggcctgtgccgcaagacgcgcgcggccatccccaccgccattcgtcggggcttggaaaaccatcccgaaatcgccttcgaactgctcaacgcccacgacttgctgcgcaacacctgatcactttttcagcccgacccgtttgcgcatctcggcggtgatgctctgccgggttttcttcatctcggcccatggcgcgtcgccgacctccgccagacgctcgtgaacgttatgcacgttccattgatttgcgcccttgatctcggcgacttcctcgcgaaacagcggcaccgacaccggcagaccttcgcgggtacgcgcggcgtaagcgcagatggtggtggcgcccagaccgttgcgcaggtaatcgatgaagatccgcccgacacggttctttggcccggacaccgccgaaaagcggtctggcaacagcttggccatgtggctgacgatggcgtggctgaagtccttgacctcatcccagccgagtttgcgggtcaatggcaccaccagatgaatgcccttgccgccactggttttaaggaacgctttcaatcccagttcatcgagtacagtcagcgtcagcgctgtcgcttcgaccatgcttttccacggcagcgccgggtccgggtcgaggtcgagaacgaagcgatcaggcttgtccagatcgacggtggtggcgttccaggtgtgcagctcgacggtgctcatctgcaccgcgccaatcagcgcttcggcgttgttgatcagcatcaccggttgtccggtgacgtccttgtccagcgtagcgataccggggatcgccaagcgttcggcgttcttctggaagaacaactcgccggcgatgccgtccggggcacgcaccagtgccaccgggcgctccttgagctgcggcaggatccattcggcgacactggcgtaatactcggcgagttgcattttggtggtgccactgaccgcgtcgatcacgcgatccgggtgggtgatgcgcaccttgccgctggccagtccgagctgcgatggcgcgctctcggcattgctcgccggggcttttttcgtggtttttttcgcggcgggtttcttctctgcagtcttcaccggtttcgctcgctcctcagtgatgtccctggccggtttgtcatcgcgcagaccatggaacacggcgtggcgcaccgaaccgtccttggtcatttcggcaaacgcgacttccgccagcagtttcggcttgagccagtgcacgcctttgacctcgaaaccgctgggcggattgaccacggcggcttgcttcacctgcaagggtttgagttgcgccagaatgctttttaacgtcgactcgttgaaaccagtgccgaccttgccggcatagcgcaactctccgctgtcgcgatcatgcagccccagcaacaaggcgccgaacgcactgcgcgaacctttcggatcggtgtaaccgacgatcacgaactcctggcgatgcttgcatttgagcttgatccagtcgccgctgcgtcgcgacacatacggcgagccaaggcgtttgccgatcaggccttccatctgcatctgacaggcactgttgagcaacgcgtccggcgtttcgtcaaaggcttcggagaagcgcaacaacggttgctcatggctgccaagcaccgtggccaatgcggcgcgacgttcctcgaccggcacttcacgcaggtcgaccccgttgagatacggcagatcaaacaggtagtagaggatgttgccgctgcgcccggcctcgaaagcattttgcagggcctgaaaatccggcacgccttgttcattggcgacgaccatctcgccgtcaagccacgctgactccaatcccagcgcggccagcgcctcagcctgttgcggcagtttgtgcgtccagtcgtgaccgttgcgggtaaacagctgcacctgatcatggtcaatgcgcgccatgatccggtagccgtcgaatttgatttcgtagctccactgcccttcgggcgcgctatcgaccaaggtggccagctccggcttgatttgtgctggcagtttggccttgtgtgcgccagtgagcttgccgctcgcaggtttgcgggttttcgccgcaggcttgtttagcggtttgctttgctcggcggccagtttgggtttgccgacgatggtgcgctcgctcagcacactgtccggttcggccaccagcacgtcgtaattatcctgcgggcgcgcggcgctgtcctgatgcttgatcagaaaccattgctctttcttgcccggcatgtgcgtgcgcaccaggttccagatgccgccgagcttctcgccctgcagctcaaacttgagcttgcccttggcgtaggccttgtgcggatcttcctgcggtatccacacgccacgatcccagacgatcacatcgccggcaccgtaatgcccttcgggaatactgccctcgaacgtcgcgtaatccagcggatgatcctcgacatgcaccgccagccgcttgaccttggggtcgagtgacggccccttcggcaccgcccagcttttcaaggcgccatcgagttccaggcgaaagtcgtaatgcaggtgcgaagcgtcgtgcttctggatgcagaactgcaaggcgtgctcggtggcggatttgcgcctcgaacgtttgacggccgccggttctgacgtcgccgaaaagtcgcgcatgcggttgtagtcgtcgaggttcctgttcatcgcgtgcctgccttttttcagccgattcgggtcaccgtcagcgccaccacggcgattcggtctacccgttgataaccggggttgagcagttcttcgccgaagacatccggatcgagttcgcggtacgtccagccgaagcgcttttcatccagtcgtggcagcacggtgtcgagaaacggatcgcgaccatcgaccatcgccacaccggtgtagagcaacagcgagccgccgggtgccagtcgattcaacgcctgctcgacaatgcgcagcgacagccccgcccccagcgtcccgccaccgtgacgataagcgcgctctgccggatcggccatgtacggagggttggcaacaatcagatcgaactcgccctcggcaccctgcagaaggtcactggcgtgcacttcgacgttggcaacctccgccagtgcggcgttgatcgaagtcaggcgcagcgctgcggggttgatgtccagcgccagcacttgcgcctcgcgacgggcacggccgatcagaatcgcgccgacgcccgcaccacaaccgatatccaccgcgcgatggatgggcgcgaagttctgctgcaagtgagcgtgaatcaattgcgcgaaacgataggtgtccgggccgaaaaacaccgcatcggccgcgtcggtggggaacgccgaatgcacgaacagcagatcatccagactcgaccagcgcacgcgactcttcaggtggccttcgtaactatcaatgacctgcgcgtcttgcagctgccgctgttcatcggccgacaacaaccccggcgcgaacggccgcgaccagccaaaaacgtcgcgcaaagagtcggccatctggccctcgtcacgctgattgacccgctgatgggtcaacggcgtcggcgtaacaaaccgatagccgtctgcaaacaaacgccggcccagttgcagcagcacaagatcgttggggcagagttgctcttcctgattcatcggtgatgtccttacggcaagcgggatttgagttcgataaaacggcgggtagcgagcagtccggcggggtgtgcatggcgcgccggcgcaagccacgggatcagaatcgcgatctgcgccagctcgtcctggccttgcagcgccgcgttgagcgcctgtacgtcgggatcttgttcaagcccttcgatgaccgctgcggcctgactgtgccgtcgaacgggtttggttttatccgaagaagtccagtcacccgcaatccagtcgtggaccagttgtttctcgtaggcattgaacacgccaaacatcgccgcaccgtcgcccgcgatcagttgccaaaagcgactggcctgcgggtcttcgtggcgtttgatccagcctttgttctgcaacgcctgcaggaatccgggtaattgttccggtgcagccagccactgattgacggtctgcccttcgaaacggcagtaatcggaatgcatatgctgggcgaacggacatttgcgctcgagcatcgccagcaactcgtgctcaaggtcgaacccttcaatgatcgcgcgactgccctgccccagatcgttgagccgatagcccagcgcgacccggcgcagaaattcgccgcgatcggcctcaagcggcagtagatcgagcgctgcctgcacggctttttgcgcatggccggtgctggcattgtcgatggtcacatgcagggtgaagtagtacggatcgatgcccagttcactgagttcgtaactgctgatcaacaagtgcaacggcagttgttcataaccgaggttgtagccgatcacctcgggcaggtaatccgcgccacagacaccgagagccagctgtattgcgccttgcaggtagcgttgatcatcgatggcactgctgtcctgcaagtcgtgttcagcgagcagtttgcggtagatcaccacatgattttgcgccggattgccatcgcccagttcttccagaaaagtgcgcagcaagccttggaaacgcgggtcccgccagcgcggcaacaggccagaaagccatgcaccatcaaccagtttggtcggtgccaccgcttgcaggaaatacagcgcctgcgccttgccgcggaagaattgccgtggcccaccggccttgcgctgttgcagatagtctgagtattggctggcaacgtcggcgcaatgttcggctacccaggcatgccaggtcatggggtcttcgggcagggaatcggaaagctgcgcggcgtgttgcagttgctcctgcaggaacgcctgtgcgaggtcttggggattatcatcacgcaacaacgcgtcatatatctggcggacgttcccgccgccgttcatcacgtgcggtttatcggtcgcggtgtgcaagcgtgtcaggacagtcatggcaaatattcccggtcggttggcaggacgctgttgcacgcgcctctacagcagcagagaggcagcgcctgcgaaaaattcaatcgacgtgaaaattgcccggacggacggccacgcagctccttggcggagctgcgggtggctatgattttttgacgttacttcaggcctgccctttggcctgctgctcgagatgcacctgcaaatccgggtcgatctgcaatgctgccgccagttcatccagataactgcgctcggcgtcctgttggtcgtccaccagcatcacgctggcgaggtacatttcggcggcgacagccgggtcaccgtttgccgactgcgctacctcctcagggtccagcggcttggcgccttcagcgtcgagccattgctgcaactgcggatcatcggtgtgcttgccgatttcgctgctgatcaggtgtttctcgtcttcatcgatacgaccatcagccttggccgccgcgatcaatgcgcgtaacaccgcgtggctgtgctcttcaatctccgggccggccaggaggttagccgtttgcggcgtttgttgcggtgccgaactggcctggctgcgttgccaggcctgatacgcctgaaaggccatcattcccagcgatgccagcgccgcatagttggtgccgccggagcggctttgcgcgccgcccccgccgcccagtgccccacccaatgcgccgcccagaccacccccggcaccaccaccgagcaacccgccgagcagaccacctaatcctcccaaccctccagccgctgcgccgccgcgcgtggcggtggaatcggcgccaccgagcagaccacccagcaagccgccgagaccacccaaaccatcactggcagaggctgaagattgttgacctgccggggcctggcctcgcagcagtttttcgagcaaatcgctggtgttcatgacgtcatcctcaggcaaaggcagtgactgcgtctggcaacgatagaccccttaagccattgcgccagcaccgtttggctgagactcaaagcgccaacggatttcgcccgcgtttttttcgccgggcagctaagattcaaggatggtgaaccttatcccggccagaccggtcgatagctgcaaccccgacccggtttgccggcgcccttgttgcccaagggtgatacccggcctgcttcatttttttggagaacgcccctgtgatatcgaccgtacacatcgccaggctcaaagcatggggcgcccatggttttaccgcgactggcgtggtcactgcctttctggccactctcgccctgttggaaaaccagccgacccattgcctgatgtggctgggcgtggcgctgatcgttgatggcctcgacggcgcactggcgcgaaaggtcaacgtgcaatcggtgctgccgagtttcgacggttcgatcctcgatctggtgatcgattacctgacatacgtgttcatcccggcgctgttcatctatcgctacattccgctgcccgattacaccttgctgctgaccgtgtcgctgattctggtgtcgtcgctgttctgcttctgcaacgtcaatatgaagagcaaggacaactactttgtcggttttcctgctgcgtggaatgtggtcgcgctgtgcctgtacatcatcggaccggggccgtggatcacttttctgacggtgattggcctggcattgctaacggtgacacggatgaaattcctgcatccattccgtgtacgccggttcatgccgatcaacattgcagtgacggcgatctggctgctgtgcagtctgtcgctggtgctcaaccacccggtgatcaacccgttggtgatggggctgtggttgctgatgtcggcgtactttctggggatctgcatctggcgcacggcgctggagtggtttgagcggccgcaggtgaaataggctccagaatccaacacacatccaatgtaggagtgagcctgctcgcgatagcggtctgtcagctgaatatttttttactgaacgaccgctatcgcgagcaggctcactcctacagggatcgcaatagattcgaaaaccgggtgtaactcagcgtttagtgatcaccacctccagatactcactcggcaccaccaacgaaccctcccccgcccgattcaaacggttgagcaaatccgccagatcactttccagcgcctgtccgctttccggcggcagtgccgcgaaggccttgtgcaccggcccgtaccaatggcggaaaatatcgatgaaatgcgcggccgaacgatagcgaaaattgaactcgcggcgcatcacgcgcaccagaaaatcacgatcatcgaagtgcttgtgcaaccacgcatccgagccccagttcgatggcggttgcgcgccagcgggcggaggcaggtggcggccgaggattttgaacatctggccgacgaagccttccggggtccagttggccagaccgatccgaccgcctcggcgacagacgcgtcccaactcggcagcagccttgttctgatccggcgcaaacatcacgccaaaggtcgacagcacggcgtcgtagctctcatcggcaaacggcaatgcctcggcgtcagcaacttgaaacgtcacgtcgagatgctcagcgcgggcacgatcctggccgcgttccagcagcgctgcgacgtaatcggtcgaggtgaccaggcaaccgcgccgcgccgccgccagcgttgcattaccgttgccggcagcgacatccagcacctcctcatcgcaacgcaggtcgcaggcttcggcgaggttttcgccgacgatttgcaacgtcgtgccaatcacggcgtagtcgccactggcccaggcgactttctggcgttccttcagggcagtcagatcaatcggggtactcataagagtgaactccgctgcgggtgggatcggtgatcattcggccgtcgtcggatcgatgaccgtcaccacacgcgccacactgttggccggaaaaccaccgagcctggcgtgttcgcgtacctgctcttcatcaggtgcgatgtacacgcaatagatcttgtcagcggtgacgtaactttgcagccactgcacttgcgggccgagttcgcgcaatacatcacaggacgttttcgacacggctttgagttctgcttccgacagcttcccggcccctggaatctcgcgttcaatcacgaatttaggcatggcaacctcgcgctcttgttatggggcaaggccggcagtgaccctgctcaagcactatcgcgccgagaccgcacggcgtccccgccaatcgtctggcaacccccgaaaacagtgggttcgccgatgaatggtgagaatctgtaaagcctctggaacaccttgaggattgccaaggttgggggattggtttctgatgctccctcgcttctggaacggactcgactgatgtcactgaaactcgattggctcgcgcatcacatgcaccacagcgaccgttatgctcaatggatccaccaacaattcccctacgaatacgtcgaccacccgctggccgagtggcaacgtgagttcgccgaaggccaaggcaatggtgactggtcctgcctgatcgccatgcacggtgaacaccttgtcggcggcgccgcgctggcacgcgatgacctcgccctgcgtcctgatctcggcccatggctggcctgcgtcttcgtcagtcctgaagcgcgcgggcaaggtctggcggaacgtttgattgaaggggtttgtcaggaggcgaaagactgcggatttgcgcttctgtacctgcacacgcaaaacaagcaggactactacgccaaacgcggctggcaggtgctggaacgttttcccgcctgggacaacgaacaatggctcatggtgcgcgacctctgagccattgatttcactgatcaggccgctggcgccttcgcctcttgcagcaactgctggatcatctgctcctgcgcttcgtagcgaccttcgccgaagtggctgtaacgcacctgccccttggcgtcgatcaggtaatgcgccggccagtactgattgtcgaagttgcgccagatcgcatagttgttgtcgatggccaccgggtaggtgatgccgagttttttcacctgatctctgacgttgtcgatgatccgctcatagccgtattccggggtgtggacaccgatcaccacgagaccgtctttttcgtatttctttgcccagtctttgacgtacggcagggtgtgctggcagttgatgcagtcgtaggtccagaagtccaccagcaccactttgccgcgcagagattcagcgttcagctcgggcgagttcagccattgcaccgcgccggaaagtgacggcatcgcccctttgccctcctccatcggcgagtccgcacggactttgctgacaaagtagtcgaccactctcggcacgttttccagcacgcttttctcgacgctgaccacgccttgggaggacgtggtcgccagcaaggttttatcgaagccgctggcaatgaccgccgccgtcgcgagtaccgcaacaccggcaccgcggcgcaaccaaccggtgaacggtatcgacagcttcagccgattgaccagcccgcgcccggcaaaaatcaaggtccccagcgacaacgcactgccgacaccataggccagcagcaacaggctggtctgcgcgttggcgccttgcagcatggcaccggtgaggatcacgccgagaatcggcccggcgcacggtgcccacagcagccccgtggccacgccgagcatgatcgagctcaacggtccggcctttttccgggtgtccgggtcgaggcgattgccgagcatcaccaaggggcgcgtcagccagtcgccgacgcgtgccgagatcagcgacagggcgaatacgctcatcacgatcagtgcgacgtagcgcccgctgttgctggcctggattacccattcgctgctgaccacagcgaggctggagatcagcgcgaaggtcagggccatgccgccgagggtcagcagaatcgaggcgcggctgcgttgcgcaccggcaaacagaaacggcaccaccggcaggatgcaggggctgagcacggtcagcagaccgccgaggaatgcgatgaggtacatagtgagtcacccttgatcaatgaatgtaacaagccattcaaacgttctggctttccagccaatggctctgcggcgtacggctggcgccgttctcggcaaacatctggccctgcggcgtgcggctggcgccgtcggctgcaaacatctggccctgtggcgtgcggctggcgccgtccgcggcaatcatctgcccttgtggcgtgcggctggagccgtccgcggcaaacatttgaccctgcggcgtgcggctggcgccgtcggctgcgatcaggccgtcgctgccctgcttggccaccggcgtcagctggaagcaggtgccgctgtggcagctatgctgttcaaccgcagcgttggcatgggtgacgacgccggccagggagaaggcgatggcggtcaaaaaacgcgatacgttgttcatggctgtttccttctataaagagtgatggcttagttgtcgttgttgcagccgtcggcgaatttgctgtaatcgagcacgcgggtctgaccggccgaatcgaggtaggtcatgcgcgcctcgacgatgccgcaagtcaccgagttgtcctgtttcagcgagagcactttgtggatatccaggtgggtgccgtatgtgtaggtttgcgcggtgacatcggcttcggcgcgggccgacagcgtgcaaatgttcagcgcagcaaacaggcaggcggcgatgacggacttgttgttcatggcgtgttcctcaaggcttcagtgggtttgagccgaggcgatctgtgtgtgcctcgatggagcctatttgaggctcgcgaggtatcgcgtctgtgtcaggaaaagccgcgtttcaatcgctgtgtatccctgccatagggagatacacagcgatacaaaaccctggaagaaccgcgtttttgcgtgctcatgtatccgttgtcacggcagatacactgcaatacaaaggcaggcaggcgagccgcgcgaggctcgatagactgcacggcattcccctttgatatagaggctcgaacccgatggaacatgtcgatcacattctcatcgtcgacgacgaccgcgagatccgtgaactggttggtaactatctgaagaaaaacggcctgcgcaccacggtggtcgccgatggccggcagatgcgcagttttctcgaagccaacaccgtcgacctgatcgtgctcgatatcatgatgcccggcgacgatggcctgcagctgtgccgcgagctgcgcgtcggcaaacacaaggccacgccagtgttgatgctgaccgcgcgcaacgatgaaaccgaccgcatcatcggcctggaaatgggcgccgacgattacctgaccaaaccgttcgccgcccgcgaattgcttgcgcggatcaacgccgtgctgcgccgcacgcgcatgctgccaccgaatctggtggtcaccgaagccgggcgtctactggctttcggccgctggcaactggacacctcggcgcgccatctgctcgacaaggacggcaccatggtcgcgctgagtggcgccgaataccgtttgctgcgggtatttctcgatcacccgcaacgggtgctcagccgcgatcaactgctcaacctgacccagggccgcgacgccgacctgttcgaccgctcgatcgatttgctggtcagccgtttgcgccagcgtctgctcgatgatgcgcgcgaaccggcctacatcaagaccgtgcgcagcgagggttatgtgttctcgctgccggtcgagatcctcggtgccccggcatgaagctgaacctgcactggccgcgcaccctcgcctcgcgcctgtcgctgattttcctgatcggcttgctgctggcccaggcgctgtcattcggcgcgcagtattacgagcgttaccagagcgcgaagaacaccatgctcggcaacctcgaaaccgacgtttcgacctcgatcgccatcctcgatcgcttgcccgccgaagagcgtcctgactggctcgagcgtctggcgcgaaaaaattatggttacctgttgagcgaaggcgaaccgggcacgccgatcgaggccggggatgtgccggtggccgttacctcgatcaccgaggccatcggtgagcgctacccgttgaccttcagcgatattcccgggccgaagaaacactttcagggccacctgcgactgagcgatggcagcccggtgaccatcgatgtacgcccggcgatggccccgttgtcgccgtggttgccggtggtcttgctcggccaactggcgctgatgatcgcctgtacctggctggcagtgcgcattgcgatccgcccgctgacccgcctggccaacgccgtggaaaccctcgaccccaacgcccacccggtccacctcgacgaaaaaggcccgaccgaagtggtctacgccgcccgtgcgttcaatgcgatgcaggcgcgcatcgccgcgtatctgaaggaacgcatgcaactgctggcagcgatttcccatgacctgcaaaccccgatcacgcggatgaaactgcgcgccgagttcatggacgactcagcggaaaaagacaaactgtgcaatgacctcggcgagatggagcatctggtgcgcgaaggcgtggcctatgcccgcagcattcatggctcgaccgaagaaagtcggcgcaccaacctggattcgttcctggaaagtctggtgttcgactatcaggacatgggcaaggatgtgcagctagtgggcaagagcgaagtggtggtcgacacccgtccgcatgcgctgcgtcgggtgttggtcaatctcaccgacaacgcgctgaaattcgccggcagcgccgaagtctgggtcgaagcgaacaagggcagcctggcgattaccgtcatggatcgcggcccgggcatcgccgaaacgcaactggcaaaagtgatggaaccgttctatcgcgtggaaaactcgcgtaatcgcgacactggcggcactggcctcggcttggccatcgcccagcaactggccatggcgctgggtggttcgctgaccttgagtaatcgcgagggtggcggcttgtgcgctgaactcaagctccctctccattcttgatatctacaaataaacctgctcgcgaaggcgtcctgtcagtcgatgttcaagttgactgacagatcgctttcgcgagcaggctcgctcccacagggtgcggcgcggttcaagtgttcaaggtaccagaccgatcacctggtcctcatgcatctgctgcaacaacgccagcccactgtccatgaacgaagcgctcgccgactgtccggcctcctgcgccagagcttgcaactgctcgcgtcccgtcaacggcgcaaactcgctgatgcgctgtagcaaccgccaggccagcgggctcaattcggaaaacttcacactccagtctgccgtgcgccgcaccagcaacagcgtcggttgcgccggtggcgtggcgggttgattattcggctcgagttgatggacaggccagacatacgccagcggccaggccagcgccgagagctgcagcgggcgctccagcaacagcaccggatctgtccatgacagcacctcagcatcagactgctgcaagaccatctcgacccattcgtaatgcgccagctccagcaggaacgccggccactgcccctctcgcaacacctgcggttgcgtcgcgagatagtcgagaaacgtttcggcaatctcgccaaacttcggcgtctgcgcccgccagtcccgcaaaaaaccgcgcaccagtaagccccagcgttgctcaccgatgatgcgaatcaacactgcaaacgtgccgctcaacagttgcgatacgttgttgaacaccaggtcgcgatagacgttaacccgcgccgcgttcatgtcgaccggcggcgtttgacggtcgggatcgcgcaagtatcgggtcagcgcctgttgttgctgcaagaggttatccatggttggcctcccgggattgcaggtggcggatgatctgcagctctgcgaccagttcggcgaatgccgggaagttgaagtctcgctccagcaaggtcggctgcgtgccgaagtgcctgtaggcctcggccagcaacgtccacaccacgggtttcaccgaagccccgtgtgtgtcgattttcagcgaatcggactcgtcgaagtgcccggcgacgtgcatacccacgaccctgcccggctcgatcccggcgagaaatgtcagcggatcgaaaccgtgattgatcgagttgacgtagacgttgttgacgtccagcagcaggtcgcaatcggcctcgcgcagcacggcattggtgaaggtcacttcatccatgtcctgacgcggagccgcgtagtaagagacgttttccacggccagacgccggccgagaacgtcctgagcctggcgaatccgcgccgcgacgtggtgcaccgcctcttcggtgaacggcaatggcagcaagtcgtaaagatgcccgtcatcgctgcaataactcaggtgttcgctgtacagcggcacgtggtaatgatcgagaaacacgcgcacttcctgaagaaacccgctatccagcggtgccgagccgccaagcgacagcgacaagccgtgacaggacaacgggtaacgctcggccaactcgcgtaaagccgctccgtgggcaccgccaacaccgatccagttttccggggcgacttctagaaagtcgaaatcacctgcgctggcggcttgcagatccttgagcaggccacggcgcagaccgagtccgacgcgcgagggcattgatgatttggagtttggcatggacacctctgatgatggctgacccatacagttgaaacggtggctgtatcagcgctgtgtgcagtctcggcaacttttgccacgccgtgtatcaacaggtaattgggatacacgccaatacaagaagccaatttccaattacccaatcgcgataagaaaacagctttttacacctgtcagagttgacagtatcgaactttcaaaatgcttcttagactcgagaaacaacctcaaaaccaagaagagcgtttatgtctcgacagccgaatgcaacagcaggaaccatgaccgcgaagagtgttgacgagcctgatttcgttgccgattctcggttcgagatcagtcgcttgccaaatcactggcaaatatcggctgctgacgcgtcagaacagggtaatcgagcgttgtatatacacgtgccggccagcctgcctgatactggtatagaaaaaacctacccgcttaatgggaatgacggggcggaaaacgcttggattcgttatatttcaggtgactttatggtgtcttcgagcaccggttctctgacgctccgatattacggcgaccaagagaaaatggtgggaacctttgatttcgaaggtgggtttggcggcaagcgatttcggctgaccgatggtcactttgaaatgaccgggttaaagaaaccgggcgttcacaccacaaactcgcttaccgcagacgtgactggtgctttttcggtgatgtactcgactaagactcatcaagtcaatttcttaccggacacccaaaaactcgaattatttgcctctgaactgatttggagccctgttccaccccgtgtacacacgttcatgctgaatcttcctgagggtactaaaaaaggtatttataaaatcggcaaatttggcgatccgatttatgcgtcctacaacgtcctcgccgccgacggtaatcttttcccatccattgaaggagacattgagttgctcgcagacgcttctgttgatcatctggaagctaatctgcgctttactgcgatcgctgcaggagtccccgataaaaaattgcaaatagccgatggaaaagtcatttacaagcgtataccggccaagtaactgcgttacgccctgaggcacttactgatcacccacaatcagagcaatctgcgcgggcaaaatgctcctcgaattgcccagcaagactagactcctaattaccctgttcccacaacagggcaaccggggcgatggcacgcaggacgcggctttcgctcgaatccaagacgaccacaccccagaggtgtatgcctgggataagcaagacctctggatcgtgatccaggcacaggagcaccatcatggacgaactcaaacttaacgaattcatgggcaaactggtcaatgacatgggcggtgcggcaatgctggccaatgtcattgtcggtgaggaactgggactctatcgggccatggccgacagtcagccgatcagccccgaagccctcgcggcaaaaaccacctgcaatccgcggctggtgcgcgaatggctcagtgcacatgccgcgtccggctacatggaacaccgtgacggccagtttcgcctgccggaagaacaggcactggcgctcgccgtggaagattcaccggtgtacatcgccggcggattaggcgtggtggcgtcgtttttccatgacaaggacaaactggtcaaagccatgcgcggcaatggcgccctgccctggggtgatcaccatccgtgcatgttcaccggcaccgagcggtttttccgcccaggctacaaggggcatctgatcgctgagtggctgccggcgctggacggtgtcgtgggcaaactcgaaagcggtgccaacgtcgccgacattggctgcggccatggcgcctcgacggtgatcatggcgcaggcgtttcccaactcgcgcttcgtgggcttcgactaccacgcgccgtcgatcaccgtcgccactcagcgcgctgaagaaggtggcgtcagcagccgggcgaagttcttccagggcacggcgaaaagctatcccggtgatgactatgacctgatctgctatttcgattgcctgcacgacatgggcgacccggtcggtgccgcgcggcatgccttcgaatcgttgaaggacgacggcacagtgttgctggtcgagccattcgccaacgatacgctggacgacaacatcaacccggtcggacgactgttttatgcggcatcgacgtttatctgcacgccgaattcgctgtcccaggaagtcggattgggcctcggtgcgcaggccggggaagtgcgcttgcgcaaagtgttcaacgaggccggtttcaaacaattccgccgtgcgacgcaaacaccgttcaatctgatactggaggcgcgcaagtaacgctgcataaccctgtggttctgcaaaaaacctgtggcgagggggttgccccctcgccacagggtcagtgctaatctgcatggcatcccgccgcccccggagtgctgaccatgctcgacagcccaacccgcaaacacctcgacacgttgcaacaggcgatggccgatggcgattttctggtgctgaccggcgctggcatcagtacgccgtcgggcataccggattaccgcgacagcgacggtgtgcgtcgtggccggcaaccgatgatgtatcaggaattcctcgcctgcgccgaatcgcgtcgccgctactgggcgcgggcgatgctcggttggccacgggtgcgtcaggcgcaaccgaatgcggcgcacgaagcgctggccggtttgcagcgacatggcttgctccacgccttgatcacgcagaatgtcgacaccttgcacgatcatgccggcagccatgacgtgatcgaattgcatggcagcctgcatcgggtggtgtgcctggattgcggtcagcgcagtgagcgcgattcgattcaacgtttgatggaaatgcacaacccgtatctggcaggtgtcgatgcggtgctggcgccggatggcgatacgttgctcgatccggcgtttgaaggacgttttcaggtgccgcgctgcccgcattgtgcaggggaacggatgaaaccggatgtggtgtttttcggtgagaacgtcgcgcagcccaccgccgcccgagcgatggccgccgccgagaatgcggcgggtatgttggtggtgggttcgtcgttgatggcatattccgcatttcgcctgtgccgggtgattgccgatcgcggcaaaccgttgatcgcgatcaacctcggcaagacccgtgcggatgacctgctcgaccttaagatcgaagcctcctgcgaacaacttttgccgttgctcgcccaccacctgaatgcccccctgtaggagctgccgcaggctgcgatcttttgatcttgaacaacaacatcaaaagatcgcagcctgcggcagctcctaaacggaggggtgtgtttcaggcgtagtgatcctgttggaggatatcgaacagtgcttgcgccgctgccgagagttcattgcccggttcggtcagcacgccgatggcccgttccaccgagtcgttgagtgtcaggcagtgcgcgccgagttccagcatctgttcggcgcacaacgctggcaccgcgctgacaccgagtccgctggcaaccattctgccgaccgttgccagttgatgactttcaaactccaccggcaacttctttccgcgcgcctgcaagtgctcctccagcatcacccgcaccgtcgacggccgttgcaaggtaatgaacggttcctgcaacaaggtctgccagtcaatctcagcgcgctgcgccaatggtgaatcctttggcaccactgcgacgaagcgatccatgtacaacggcgtaaatgtcatcgaagtgttctgcatcggctcgaacgctacgcccagttcaacctgacggtcgcggaccatttccagcacctgttcattgatgacgtcgttgaccgtaacgttgacgtttggataacgcgcgcgaaacgttttcagaatcggcggcaacaggttgccggcaaatgacggcatcgccgccagcgtcacgcgtccgcgttgcaggctgaagcgctggcgcatttcgtcttcggtgttgtcccagtcggcgatcagccgtcgcgccagcggcaacagcgattcgccttccggggtcagcgcaacgttgcgtgtgttgcggctgaacaggcgcccgcccaggccctcctccaacgccttgatcgtcaggctcaacgccgattgcgacaggtgcagacgctcgcaggccacggcgaaactcaggctttgagccacagcgagaaaggcgcgaatctgtttgatggtcatactcaaacctcaggatcgtcgttgatgatcgttcccacgctctgcgtgggaatgcagcccgtgacgctccgcgtcactggacgcggagcgtcccttgatcgtcaagattaaattccgaaaccccaattgcgaaagcagttggggttttgttttagtagaaacatccgtttttgctggcctgttaccgtgttgacaggtcagatacagaatttcttgacgaccatagagcgttggaaccacctgatcccatcccgaactcagcagtgaaacgatgcatcgccgatggtagtgtggggtttccccatgtgagagtaggtcatcgtcaagattaaattccgaaacccctgtctgctaacgcagacaggggttttgtcatttcagtgcctgccaaaaccgaacgtcaaactgctttgcgtgccctgctgatgcgtcgtgccagccatttgcgccaccagatataaacgccagtccccgacaaccccgcaatcaaaagacctagtaccgcgatcatcacctgcccggtaacaccaatgatccgacctccgtgtatgggcaactgcaaccggtaaaactgttcccccaacgttccctgtccagcgatctcctgccctagcaatcgcccatccgtaccgtgaaagaacaaccaggatttaccatgagcgtctgtgtcgtgttgaccaaatcctgcaccgtaaaagttgtattcaaagctgtagtacaactccccgatcccagctgtcagtcctaacctttttccctcctgtaatgccctctcgtatgcctgttgataactcaactgcgttatcccaagctcacccacaggcatccgccctcgtgcctcatagacgctcggttcgatcgatgaaaacaacgacacagcaggcttgaacacctgactcggcaagttcatcgccacactgctgacagcgattggcagcaataaaagccacaaccacaacccaccggcgcgatgcaggtcgaagttcagccgatacgcatgcccacccttgatcttccaggccgccgaccacttcttccagaacggcttgccacgcggtaacgtcagccacaaagcgatgaaacaatcgatcacccaggcgatggctaccaatcccatcagccacaacccccaattgcctggcaatgtcaggttgtagtggaactcgaggataaacgggacaaagttttcccgctgaaaacagcattccccccagtaacgctgccccttctgttcagcgttcaccggatccagatagaacacctgattacgttcatcaaacggcttgccggtcgttgggtcattgcgcggaaccgccgccagcaatgccgtatgccccgcctcatgcggatactccatataccagacctgcagcttcggatgtgcagcttgcagcgcatcaaccagctcgcccggtggcagccgcgaaccttgcgcagaagctgaataaaactgcggattcaaccattcatccagctcatggttgaacgccagaatgctcccggtaacgccagcaagcagcagaaacaccgccgtggccaagccgatatagcgatgcaacaaaaccagaaatgcgcgcatgaaaaattttccttcaaatacgacaaagccagcccctgacattcaggggctggcttttttatgcacaggacaaaaggtttagaactggtagctgacggtcgccgcgacgttgcgctcttcacccaaatagcagaagttcagactggcgcaggacgccacataggactcattggtcagattgttcgcgttcaggcgaacgtcgacgcccttcaacccgaccttgcccaggtcgtagccaatcgaggcgtcgaacagtgtgtaggacggcaccttcagggtgttctccgcatccgcccagctgtatccgacataccgcacgccaccgccgaggcgcaggccatcaagtgccgcgctgtcgaatttgtagtcagcccacaacgaggccatgtgtcgcggtgcctgcgtcggcgagttgcccttgttctcgatcacatcggtcggcgtgctcaacgtgctgaccatcgacttcgaatactcgatatcggtgaaggtgtagctgccgaggactttgaggttgtcggtcaactgcatgtgcgcttccagctccagaccttgcgagcggacagcgccgacagcgcgatagaagttttcctgcggcagcttggtcgccaggttctcctgatcaatgcgaaacagcgatgcagtgaacagattgtcagtgcccagtggttgatacttcagaccgacttcccattgtgtgccatcggtaggtgccagcgggttcccggcgctgtcggcgtaggagttagggttgaacgactcggaataactgatgtacggcgccagaccgttatcgaacaggtagagcgcgccggcacggccagtgagtttggtgcggcggtcgttgatctctgtcccctcagggcgccctgcttcggcaatgcggttttcatcggatgtctcgacccagtcctgacgcaggcccagcgagaagcgccatttgtccatctcgatcaggtcttgcaggtaaaccccggtctgctccaggcgccgcaggtaactggtatcgccatacatatcgatcgctgagttgccgtacaccgggttgaacgcattgatcggtgcgagcccgccgctggtccagtcgaccacggttttacgccgctgataatccgcgcccatcaacaccgtgtgtttagtcgcacccgtgaaaaattcagcctgaagcatgttgtcgacaatgaacgcatgcagccgctcatcaccgccggtgtagtagcgattcaactcgttgctggttggcgtggtccagccataagcgtagacctgatccatgttcactttggagtcgaggtagcggaagttctgccgtgcagtgaagacatcgttgaagcgatgttcgaactgataaccgaacgactgctgatcacgcgagtaaccgtcaatccccggctcaccttcgaagaaatgcggtgagaggcggttgccattgcgttgatgaatcgtgccatcggctggcacaccaccgtgatagccaccgtccgggtcgtgctgcagatacgcctgcaatgtcagcgatgtgtcttcactgaaatcgatactcaacgtcggtgccagggcgaagcgtttttccttgttgtggtcaaattgggtgtcggactgatccgacaacccggtcagacgataggcaatgcgcttgtcgtcatcgaccgggccgctgaagtcaaaaccaaccccgcgctgaccctgcgtgccgaccgtggcctgtacttgacggtaagtctcatacagcggttttttgctggtcaacgccaccaggccgcccggcgaactgcgaccgtacagaaccgacgacgggcctttgagaatatccacgcgctcaaggaaatatgggtcgacctgcatggtgctgtaagtgccgctgtcgcccatcgacttgaggccgtcgaggtaaatgttgtccaccgacccgtcattgaagccgcgcatagcgacatagtcataacggtgagttgcgccatacggattggtcatcacaccgggtgtgtagcgcatcgcctgcgagaccgtctgcgagccctggtcgtccatttgctcgcgagtaaccacggacacactttgcgaagtttccagcagcgcggtactggttttggtggcgatctgactgtgggtggcgttgtagccgtccatgttgcccagcgcattaccgagggcgaagcctttgatgtcggtggtgggcagggccagtgcatcgctttgcgcgaccgaccgcaaggtgtagctgctgccatccagactgatcgcttccagtccggagccgccgagcaaatgactcaatgcctgatcagtcgaatactcaccttgtacgcctggcgattgccgtccctgagtttgttgcggagtcatcgccagggtgatgccagcctgacgcgcgaattgattcagcgcttcacccaatggacccgcagcgatgttgtaacgttggccgacttcactgttaacagtgccggcagccacgctcaggctcggcaacaccgccacacccagcgcggtaaagagcagcgctgctcgaacggcatgacgcaaaacacgcgattcgccggtgaatttcggagagttcttacaggtggcggggacagtcattgtgggtttccgtaggaagtcgcaaacgcttgagttgaagtgcttactgactaagccggacagtctgcgaaaacccgccagaataatttcacacgacatgttccagggtcacccaccagcgggtgcgatagcgcaatttcaccggcaacgtctgcggcaggatggccaacagcttgtcggtgtcttcgaggcggaacacgccggacagacgcaagtcagaaacgtccgaagcgcaggtcagaaagccctgacgataacgtccgacttcgctgaggaaatcaccgaggcgcatattgcgtgtgacgatcaagccatcgacccaagcgccagcgtccatgtccggcgtcggggccgggcggacctgatgatggtcgatcagataactctgcccggcgagtgcctgtaccgaagtgctgccggaaaggatcgcaacctcaccatgggtgacgctgagccgagtgcagtcatgttcctgacgcaaaatgaagcgggcatcgacgggctcataagccccgtgacgatcttgtacgcgcagcggccgatcagacggcgcgccctcgtcggagccaccacacgtgacaatgatctcgccgcgagtcagtttgatcagccgctgctgcgcggtgtaatccagatccacggcgctggcggtgttgagttcgatgcgcgtgccgtccggcagctggaagccgcgacgctcgccggtggccgtggcgtaatcggcacgccattgctgccacgcagccgtgtccttggccaaccaagcggcggagcccatcagcaatgcgccagacaacaacttcaaagcctgtcgccgacccaaaccctgtgcgccgttttccagggtattgaatgccacttgcgcaccgggcaccgcgcgaaggttactgctcaactcggcttgcagcgactgcacccgttgccaggccagttcatgctcgtggtgttcggcacgccactgctcacactggcgattcaacctcgagttgccatggttattgcgcaagcgcaacagccaatggatggcttgcttgaccacttgctgctgcggctcgccgcgacgtccgagagacacgttatccacaggcatcagctttcgtaccgcagtacgtagcagtgatacagcgcatcagcgacatagcgttccactgagcgcagcgacaaacccatctgttcggcgatctgcttgtgggtcaacccttcgcactgcgccaacagaaaggcctgacgcactttcggtttcagtccttcaagcatgcgcgcgatgctctccagcagttcgatcaccagtgcgcgggcttcggcactcggcgtttcggcttcgggtagatgtgcgatggtttccagataggcgcgttcgatttcctcgcggcgccagtgatcaatcaccaggccgcgagcgacggtacgcagaaaggcgcggggcgttttgagttcgaggcgttcggtgcgttgcaacaggcgcacgaaggtgtcctgtgccagatctgctgcatccgctgcattgcccaaccgcacgcgcagccaagcgttgagccagccgtgatgactactgtaaagcgcctgtactgcaaactcaggtgaggacatgaacgcgaacgtcacaaatgataattactcgcattgtcatcaagggttacagaatttgcaactgccgttgatgcgaccgtcgtaaaaaaccggttatcagccgctctagcgcgccgttcggcgggaatccgccagaaattccatccatttcccccacgaccctaagatttctccgaaacgtgccgacagactggtgagacatgcgtgcaccaaagtagagcggccagaagaacgctgcctgcgctgtacatggaatgttgcatccggaacgcatccccacttttggcataagaagtcccatgaaatgaatctcaagttcagccataaaatcctgttggccgcctcgggcgtcgtggtcctggcgttcgcgctgttcaccctctacaacgactatctgcagcgaaacaccattcgccagaacctccagtcttctgtgcagcaggccggtgatctgaccgccagcagcgtgcagaactggatgagcgggcggattctggtgctggaaaacctcgcgcagaacgttgcccatcagggcaaggacgccgatttcccgggcctggtcgatcaacctgcttttacctcgaactttcagttcacctacgtcggtcaggccaacggtgtgttcacccagcgccctgacgcgaagatgccggacggctacgacccgcgtcagcgtccttggtacaagcaagccgttgtggctgacaaaaccatgctgacgccgccgtacatggccgctgtcggtggcctggtagtgaccatcgccatgccggtgaaaaagaacggcgagctgctcggcgtggttggtggtgacttgagcctagaaaccctggtgaagatcatcaactcggttgacttcggcggcctcggccacgcgttcctggtcagcgccgacggtcaagtgattgtcagtccggacaaagatcaggtcatgaaaaacctgaaagacatctacccgaacaccagcgtacgcatcgagaagggcaaccagaacgtcgtgctcaacggtcaggaacgcattctgtcgtttaccccggtcagcgatctgccgaatgcgcagtggtacatcggtctgtcgatcgatcgcgacaaagcctacgccgcactcagccaattccgcacctcggcactgatcgcgatgtttgtcgctgtcggcgcgattgcgctgctgctcagcctgttgatcaacgtgctgatgcgtccgctgaccaccatgggccgcgcgatgcaggacatcgctcagggcgagggcgacctgacccgtcgtctggtggttgagagcaaagatgagttcggcgagctgggcagtgcgttcaaccagttcgtcgagcgaattcatgcgtcgatttccgaagtgtcttcggcgactcgccatgtacatgacctgtcgcaacgggtgatggcgtcgtccaacgcctcgatcgtcggttctgacgaacaaagcgcgcgcaccaacagcgtcgctgcggcgatcaacgaactgggcgctgctactcaggaaatcgcccgcaacgccgccgatgcttcgcaacacgccagcggcgccagtgagcaggccgatgatgggcgtcaggtggtcgagcagacgatcctggcgatgaccgagctgtcgcagaagatcagcctgtcgtgcacgcagatcgaaaccctcaatgccagcaccgacaacatcggccacatcctcgatgtgatcaaaggcatctcgcaacagaccaacctgctggcactcaacgccgcgatcgaagcggcgcgtgccggtgaagccggacgtggttttgccgtggtggcggacgaggtgcgtaaccttgcccatcgcacccaggagtcggcggaagagatccacaagatgatcacgtcgctgcaagtcggttcgcgtgaagcggtgagcacgatgaacgccagccaggcgtccagcgagcaaagcgttgaagtggccaatcaggccggtttgcgcctggtcagcgtgacccagcgtatcggcgaaatcgacggcatgaaccagtcggtcgccgccgctaccgaagagcagaccgccgtggtggaaactctcaacgtcgacgtcaaccagatcaacctgctgaaccagcagagcgtggccaacctcaatgaaacgttgaaggattgtgatgcgttgtcgcagcaggccaaccgcctgaagcaactggtcgacagcttcaagatctgacctcaagtcagaccgcgttatcgttcatcgcgagcaggctcgctcctacaaattaaccgggttccatctgaaggaacccgatcaactgtaggagtgagcctgctcgcgatagcggtctacaactcaccgccaaactcaagccttaaacaaacagcttcagcacattccccatcgcatcatcggcaaacccctgcacaaaatccttgaacccgggcagcgcttcctcaccgcccgaggccggctcggcaatgatcgtccacgtcgcccgggacttgcctgcgcccagcgcttccacattcatcgccgcccacagattcgccacccccagcgtgttgtaaatcgttgtccaggtcatgctgcgtgcctgctcatcgcgggagttgagttgttcgaccaccacgttgccgtccttgaagcatttcttgcgtagcgaggacacaccctcaccggtcatttcgatgtgcgacagcgccggaatgaaacggtcgaaaccgccgaagttaccgaccactgcccagacctgcaccgcgtccgccggtacctccaccgacgacacaacgtggcagccatgcgggtttttgatcagggtgtccggttgcaaattgctcatggtgttgctccttgttgttgagtcagatgaagttgatttctttcaggtagtcgcagccacgacgcagcagcgccggggatttttgcgggtagtgcgcacccatttgctgcacgccggcctgggcgttggcgtggccgatcagcgagatgtcaccgatgtcttcctcaaagccgttgaggtagaagccgagtacgccgaacaacgcgttgtcggcatcgacgcgccccagttgctgctgccagtcggcgacgctgaccagcgcgaactcgctgccggtttcgcggaacgacgcgacgtaggcatcccagctcagcggctctgggttatgcaggttgaacaccgctcgctcgggcgaataacggctggcgtggaaggcgatgaagcgggcgagaaagtccaccggcatcaggtcgaagttcagtgcgaaggccggcacctgaccgagctggatcgagcctttgagcatcaacatcaaacggtttttgtgcggctgacagacgccgctcaaactgttgaaactgatgttgccggggcgatacaagttgacccgcacaccccgttcccgcgcccgttcgagaatgcgttcgccgacccacttcgacaggttgtagccgttgcgaatgtagatcggcggcgttgacgcggcaggcaattccagcactcgccccgcgtcgtcgaccgtacttgaagccgacagcgtcgagacgaaattgaaaacctttttgctctgcccttcgcacaaacgcagcagggcaaaaatcggctcgacgttgtctgccgccagcgactcgtaatcgagtacgtggttaacgttggcagcgttgtgcaccagtgcgccgaactcacgatcgaggcgctgataatcgtcgtcatccaggcccaactgcggacgcgttatatccgccgcgtaaacccgcacacgacgcagatccagatgctccaggcggttttctcgcagtgactcggcaaagcgttgcgccgctgtttgcccgccgccgtcgcgcaccagacacgccacttcgctggcaccccaaccgagcagcgcctcgacgatgtgcacaccgacaaaactgttggcaccggtgacgatgaccttgtgcacatcgcccatgcggctgatcggcagcggatcgatttccagtgcacgctcggcgtcggccatggcctgagcgctaagtacggcgctgtcatcggtgccgcgcaccagcgtcgcaagcttgatgatggtcggcagttcgatgaagcgattgatcgaaatgctgcggccgaactcctcacgcaaacgcagcaacatccgcgacaacagaatcgagtggccgccgagattgaagaagctttcgtcggtggaaatatcgctgttcggcaactccagcaactccgcccagatctccagcaacagcgcttcgtcggcattcgccggcaggcatttcggcccgctatcctgcacgctcaccggcagttccagcagcgttttgcggtcgaccttgccattgctggcgaagggcatgctcgacagttcggtccacgccaccggttgcatgtagtccggcaaaaactgtcgggcgtgggccttgagcgcttcgcgtgcggtgtctgattgcggttgagcgaggaacgccagaatccgccgctggctgtcgatcaccaccgccacttgccggtacagccggctctcgcgcaagcaacgctcgatctcttccggctcgacccggaaaccccggatcttcacctgattgtcgcgtcgcccacacagctcgatcccgtgctcgccccacttcgccatgtcaccgctgcggtaggcgcgcaacgtttggccgtccggcagattcaaggtcagataacgctcggcggtctgctgcggattgttcaaataaccgaggcaaacccccgggccgacgatgaacaactcgcccacagtgttctctggcaccgggtgcaaatcgtcatcgagaatcagcacctgactgttggcaattggtgcgccgaggctgcggttgctgtcaccgggtttgagctgacgcgcggtgatcagcactgtggcttcggtcgggccgtacaggttgtgcagcgtgccctggcgggtcagttgctcgatgacaaacggctcgcagacatcgccaccggtcatcacttgcacaccttccagttgttccagcggcaggatgctcagcagcgccggcggcaggaaagcgtggctcagttgccgacgacggatcagcgcgatcagttgcagcggatcacgccgctgcgtgtcgtcgggcaccaccagttcggcgcctgaaagtaaggtcgggaagatatcgatcaacgatgaatcgaaactcaacgaagaaaactgcagcacccgactcttggcgtgcaactgcacgtactcggcgtaccaagcggtgaagtgcgcaaggttggcctgactgagcaacacacctttgggatggccggtggtacccgaggtgtaaagcgccatgcacggcgcctcaagttcaggacgctggcgcatcaacggttggccgagatcggcttcggcgctgtcgacgccactgacgtcgagcccagccatcgttgcgctcagcggatgctcgccatcgtgcagcagcaacaacgcgccggcgttgtgcagaatgtattgctgacgctgcagcggatggctcggctccagcggcaagtacaccgcgccgctgccgaggatcgccagaatcgaggcgaacagcgccggacttttcggcaggcagataccgaccacccatggctgcggatgctgctcaagtaacggcagcaaacgctgttgaatagcccggctatgggcgtgcaattgctggtaactgaaggagcgttcgccgatgtgcaacgccgggcgtttggcgtgctcgatcaggctctgttgcagccgctcgataacgggagccttcgcctgttccagcaacgccgtattcgcggtgtcgttgtggtgatggacgtacgccaggctctcgagaaacagcaggttttccatgcgctcgaaatccggggctttcagcgatgtggtctgctgaaaataatccgtatcgcgggagaagcggctgaccagcaaggctacttcgtcgacgatatgcgtcagtacccgctgacgcagtgcctgaccgttgccggacggttcatcaccaatcggcacacgactgatcagtgatgagccgagaaagcacagcagatcgagtgttggtaaacccgctgcgctgtgcgcgcagacgcccagacgcaaatgcaggtgcgggatggcgcagtgatcgccggcgctgaggaagccatcgtcgatgatcagatccaccgtcgatgtacccgcaacgctgcgttgcaaggagtgaccgtgttgttcaagttcctgcgccagatcggtcatggcctgactggtgccaatcagcaaaatgtcgagacgtttcatgtcggcctcctcatcaaaccaggtagtcgcgcagggcgtgctgcacgcacggtgtgtcgagcagcgagctgttgtggaagaacttgactatgttgcccaccagcgggtgatggcgattgatcgggaacgccagtccggccatttcgtctttgagcgagcgccgtgtggcctcgctgaccggcagcgcatcgatcaggcgcaggtcgaaggctttctggatgtcgttggtcaggtagtggccgatgaacaccggcaggatctgcgcaatggtttcgcgatccgccgcgtttgcggtgtaccaatagatgcgcaccatccgcgcccagaaactcgaatggcgaccttcatcaagcaagtgatcggccatcaggcctttgatcgacggtttgaccgagtcgtcgcgggcgaacgcggcgacatcgccggtcacggtgttttcagcgatggccacgcaaatcaattcgaccgcgctgcgcaggtgctccggtgccagcgctacagccgccggaatcgcccggctcaactcgatttcatcgggcaaccggatcggctcgatgccggtcatcgccaccgtttgttgcatgaaatccatcgccaccaacgcgtggtaatcctcgtcgaccaccacggtcatcgcgtcgtaacgacaggcgaacgggaagggcacggcgaagcgatccttggcgatgctgcgtgcggtcttgtcgacgatttccgtttcgaaaatcaccacatcgttgatgaacttgtacagcgtctgcaccagcgcgaaatcacgctgttgcgggcattcgcgcaggaaggtttcactgagcaccaggggttgccggctgaggggatagatcaggcgctcgtcgtcctccagcacacgtcgagggcgggtgcgaatggtcgcgcgactctcccagacatccgcgaaagattgatagtcggcggcattcattgggccacctccgccaatggctcacgcatgctcaggcgcaggccgtcccacagggcgatgcggctttccacggcggcgatggcgctggcgtagacctcggcctcacgctgcgggtcgccatcgaccagtcggtccagcaattgctccgccgccggaccgtgatcctcggaatcgacctcgatgtgccgttccaggtaataacgaaaggtcggtgcctgctcgatgccgatgccccaatcatcgaggatgcgctggaacatggtcgggatcacgctctcgcgaccatgcaagaacgctgcggccacgctatgtcccggcgcatgcagggcgatgcgcaaggtgtcgcggacgaattgcgcggcggccggatcaacgtcgacgctttgcaacgccacgtcataacccacgccctcctgctgcagagcaacaaagcgctctactgctgtggtgctggcgccaatttcgcgcattgcatccaggtacaactcgaaatggctgtagtgcccctctgccagacgatcgtccgattcttcacccaagacgatctcgttgatcagccgggcggcatgcggatcgcgtggcggtagccagggcaagcgggtgcaggtcaattcctgttgcagacgcttggtcagcgacatgaagtcccacaccgcaaatacgtgggtctccatgaaccgacgtaataccgataacgaagttatctcggaaaagatcgggtgaatactcagttcagctttcttcagggcgagttggttcttaatgggcatcatgatgtcctttatcattgatatgaaatggaacggctgtttcaactaaacaatcaatgctgccgtaacttgcatgtgtcgtggctgcagctgattgaaactctctgctattgccgaaaagtcagtagtacccgtcggcagcgccatgggtgtttagccctaagtccgcagtcattgccggtgatgctttgggcgtgtgccgaaatgtatggcgaagttcaagctcggcgtggaaaaactaatacagacggaaagtgtttaacaagtatattttcaattatttcaagtttgctgtttttcaagtatgaagagtgctgataaaactttttatttaagttttatttgggcgtagttgctcctttcggctaataacggccaaaatcgatcgacaagagtgaatgcctcactcgaagcaactttctactgaagagaattaaatgttttaaaggggcgaaagttggccgggaccggcgcctgtacttccttttcccgtgacaaggctccttccgtaggttcctggtgcggggactgcgccgacgatgcggtgcgtcgcccgttctttattgggttggcggatcaagagtgcgggtaaattgccgccacggctattaccgattggtgatcgcgaagggcgaaaccggactgcgcggcgcgggaaggttagagcaggtgcgccagtccgccactggcgttcgtggcggcgcgggcgagggatttgtaagcgggtgattcgtcggcagcaacggcctcagcgcgaggttttgcggctctggctggcggggctggcaaggtagcgtgtgatgacatcgacaccacgattgaggtgatgcaccagcaacctcaccgagccttcgacatcacgcgcgattgccgcttgcagcatcgcccggtggtcgtcctgtgacagcttgcccaggcccatggcttcgagattgaaacgcaggaagcgttcttcttcgttgagcccgtcttcgaccagccgcagcaggcgccggttgggtgccatgctgtacagggtcatgtggaacagacgattgagccggccaatttcactgtagtcgtgttggtgttcgagctcttctatatagccggccgcgcgttcgtgatcggcgctggtcagcaacggaatcgactgccgcagggcttcggtctcgagcagaatccgcagttgataggtttcgggggcatcgccctgaatcaggggtgcgacaaccgcgcctttgtgcgcggtgacgctgagcagatcctgcgcttcgagctggcgcaaggcttcgcgcaccggcatgcggctgaccccgaacagatcggccagatcctgctggcgcagcgcagtaccgcaaggcaggcgcccatcaaggatggcagcgcgcagggtttcctcgatgaccgaacgggcaagatgcgcagggatcggtccatcgactttgatgctgtgcaacggtttgggcttctgtgtcacgactacgcaccctgttttcggctgaatttggatccaaatgacactagtgattgctctacaggttgtcaaaccgtgtagaagaacgccgttacatttgcagtttagcgcggtcgcgatgatctcatggtgccattgttttttagcgggctaagcttcaccatcaaacgctttctatcctgcccccttggaaacctgctgtggcggtacgtttcgcgatcccccggactctgcgctggctaggctgcgcactgctgctggccggcgtcatgctgggcggtctgcatgccgattgggatttttccgtgatcagccgcaaggcctctgcgctctacgggccgctgggcgccgggcagcaacgcatcgatgcctggcagaatctgctggccacacagaagcaagtcagcgagatggaaaaactcaaagtggtcaacctgttcttcaataaacaggtgcgctacgtcgaagacatcgatctgtggcacgaggtcgattattgggaaacgcccatcgaggcgctgtggaagggcgccggtgactgcgaagactacgcgatcgccaagtatttcagcctgcgccacctcggggtttccagtgacaagctgcgcatcacctacgtcaaggcactgcgccagaaccgcgcgcacatggtcctgacttactatgccacccccgatgccatgccgctggtgctcgacagcctgatcgatccgatccagccggcctcgcagcgaaccgatttgctgccggtctactctttcaatgccgaaggtctgtatttgcccggagccaagggcaacaaaaaggttggtgacaccaaacgcctgtcacgctggcaggatgtcttgaagaaaatgcaggccgaaggttttccggtcgagacgactaactaggagcacgcgctcagatgtctttgttcaaacagctgttgatcgctatctgtctgttcctggtggtcgccttcaccggcagcttcatggtcagtctggaaagctcgcgtacccagtacgtcaaccagttgcgttcccatgctcaggacgctgcaacagcgctggccctgtcgttgacgccgaatatcgacgacccggcgatggtcgagttgttggtcagctcgattttcgacagcggttactacgcgagcatccgtgtagtcgatgtgaagaccgatcagacgattgtcgagcgcagcggcattccggccgtcagcaatgtgccggactggttcgtcagactgatcggactggagccggccggtggcgatgcactggtcagccgcggctgggaacaggcggcaagggttgaggtagtcagtcacccgatgtttgctgtggccaagctgtggcagagcgcgttgggcagccttggctggctgctgatctgtggtgcgatcagtgcagtgctcggcgcgttgctgctgcgtcggcaattgaagccgctggattacatggtcaagcaatcccacgccatcgcccggcgcgaattcctgagtctgccggatctgccgcgcacgcctgagttgcgtcgcgtggtgcaggcgatgaaccagatggtcgagaagctcaaggcgctgtttcaggaacaggccgagcgcagtgagaagctgcgtgccgagtcgtatcaggacaacctgaccgggttggccaaccggcgttatttcgagatgcagttgaacaaccgcgtgagcaacccggagcaggccagttccggttatctgctgctgttgcgggtcaaggatctggccggcctcaaccaacggctcggtggccagcgcaccgatgaactgttgaaagcggtcggtgagcaactgtcgcgtgaatgcgccaaatacccggagacccagaatctcgtcacgcgaattcgcggcggtgaatttgccgtgctggcgccaggcttggtgcgtgaagaagcgctgcaactggcgcagaacctcgacaatgccttgagcagcctgcacgccaccggcgcgaccgatgtggcagcggtggcgtcgatcggcctggcgcctttcgcccacggcgattcgccgcaatcggtgctcagtctcggtgatcaagcactggcgcaagccgaagggcagggtgagcagaactgggcctgcattgatcagagcctcacggcggacgttggcgacgatcatcacgcctggcatcgcctgctggatcaggcgttgagtcagcagcggttcgagctgtattttcaaccggtggtggcggctcaggactcgcaactggtactgcattacaaagtgctctcgcgtctgctcgacgagcagggccagaccattccggccggacgcttcctgccgtggctggagcgctttggctggaccgcccggctcgatcggctgatgctcgaacgtgtgctggaacagatgaaaggacacgaggagtcgctggcgctgaacttgtcctcggcgacgttggccgatccgcaggcactgaataaagtcttcgagattctgcgcgcgcattccaacctcggcgcgcgcctgacccttgagatcggcgaggagcagttgccggaacaagcagtgctggagcagttgacccggcgcctgcgtgaactcggtttctccctgagtctgcagcgctttggtgggcgcttcagcatgatcggcaacctggcgcggttggggctggcgtacttgaagattgatggcagctacattcgcgcgattgatcaggagggcgacaagcgcttgttcatcgaagcgatccagcgcgcggcgcacagcattgatctgccgctgattgccgagcgggtcgagacggaaggcgagttggcggtgattcgcgagatgggcttgtatggggttcaggggcagttgttgggtgaaccgaagccttggcggtaagagcaaccctcaccctaaccctctcccagagggagaggggactgaccgtgggatattgacgcaatacgccgacgtgagcgatttgcgctgaatccataatcgactcgattttatagcgtcagacacttcggtcggtccctctcccggaggtagggggtgctgattgggggatgttcgggaagtacgccgacgtgagcgatttgttttaaatccataatcgacccggtttctcaggtcgatgtatgacgccagacacctcggtcggcccctctccctcaaggggactgattgggggatattcgggaagtccaccgacgtgagcgatttgttttgaatccataatcgacccgatctctcaggtcgatgtatgacgccagacacctcggtcggccccctctccttccgggaaaggggactgattaggggatattcgggagatacgccgacgtgaacgatttgtgctgaatccataatcgacccggtttctcaggtcgatgtatgacgccagacacctcggtcggctccctctccctccgggagagggctggggtgaggggcttttgattctgagcggatcagatcaacccgccctcatcctcatcgatcaactggctcaacccgcccaatgcctcacgcgcctgagtccggtccatcagcttggcctgggccgccggtggcaggtcggtgacgcggatcacgcctttctgggtcagcacctgaatcaggtcgtcgagtacccgaatcatttcgaagtcgctctgcttgagctgtttcaggctggtttccaccacttcattggcgaaccaggcctggatttcatggctgtcggccggcagcgtttccgtggcctcggcgtaggccgcggcttccacgcgaatcaacagaccttgcgcatcgcgttgcacgtaaaacattgagcatccctcggaaatgaaccagcgtcatgctgtcagcagcatagccaactgtgcgcgagtatgcggggcggcgacgcaatcgtcaccgctccggaccgcacaaacgtgacggccgccccaaatggggcggccgtttgttcacgtatcagctgttgttgtggtcgactttgatggtcgggtcgctgccggcaatcaggttatgaatgttggcgctcgaccagttattgccttccagtttgatcgtcacgtccggggtcgcggcagcggcgtcgccggagttgaacttgcccgccgagctgacttgcagcgacgacgtgccatcgaccgtggtgatcttcaggaagttatcgatggtgctgccggtttcgccctgcagcagatcgcgcaggtcgatacggtcaccttcactggccttgaagtccttgatcacgtcgttgccggtgtcgcccgctttccagacgaaggtgtcggcacccgaaccaccgatcagtatgtcgttaccctgaccgccgatcagcgtgtcgttgccggtgccgccgaggaggatgtcattgcctttgccgccatcgagccagtcgttgccgcccgaaccgaagaggatgtcattgcccgcgccacccaacagcgtgtcattgccatcatgcgcaccggacacatcgaacgcctgatagtgctcggtgatgtactggtgcacgttactggtggtgaccttgctgacgtcgaccccggtttccttggccacgaacgcctgcatcgcctgataaccctcgccggcaatgccgttgaagctgaccagatcgccgaacaggatgtcattgccgtcgccaccgctgacggtgtcgttgcctggcatcgtcgcttcggtgtggccgatgatcgagttggccagatccttcggatcgatgttggtctgcggtgttttatccgaatcgtaaggtttcagatcgttgaggctgacatcgttgttcagtccgatagcctcgacgttcgacagaccgttgagcaaggcaaaaccactggtcgagttgctggtcgttgccgagttggtgctgttaccggtacccgccagactagacaactcataggtgccgtcgccctgcgcgtggatggtgcccagattagagctgctccagccccaccacgaattgtaggtttgcagggtcacggtgccggcgctgttgatcgtcaacgcgtgggtattgtcgatgtaggtgctgaaggtgtcgcccggcttgtaattgctggttttcaccacatcgtcgagcttcacgttgccgtacagcgtcgggttggtctgctcgccgctctggtagtaggtcggctggccgtcggtgatgaagtacgtgaggttcttcgccccggtgttggccaccgcgtcagcgctctggaaccagttggccgtggtcttgaacacatcctcgtagttggtgccgccgccggaggccatcgagtccagtaccgctttgagttgcgtcagtgcgttcgggtcgttgaggtttaccgacaccgacttgttgacctgggtatcgaagtcgacgaggaaaatgttcaccgtgcccgaattgctgccgcccaggctctgcttgaggctgttgaacactgaggtcagcgaatctttggcggcgttgagcgacgacgcgctcatgctgccggagctgtcgaccatgaacgcgatgttgtaattggtgcccgggaccacggtcaggccaccgatgtcggcgacgatgatgtcgttgccatcggtgccggtgacggtgtcgtcgcccgaggtcgccacgaccgcgttgtagacggccggcaccacggtgaccggaatggtcgcggtgctgctggccgaaccgccgacctgttcggtggaggtcgaggtcacggtcaggttgaactggccgttgtagtacggcggtggcgttacggtcaggctgccgaggttccagccggtgacgttggcgtcgccgctgctggcggtgacggtgaaggtatgccctgcgccatcgctgagcaccgagccgaccggtgcgccgctgatcttcacgctcagggtttccgagccgtcggtgtcggtcagggcggtggtgactgccgacagtttcaccgtggtgccttcggcgccggtgttgagtttgtagccgtcgtaatagccttcaccgccgctgccgtgcagatcggagacggtcacgcccgaattgatcagatcctgcacgccggtgtagatcggcacaccggcgctgctcaggtcgatcggcgtgctgccgttgaccgacaggttgacgtcgtagctgcccgggccgctctggttgtggtggtagatgtccagggtgtagtagccgctggtggtcggggtgaacgagccattgatggcgccgcccgcgccccaggtacccgaagccacactcttgccgccgatcgtgatcaacaaactgtcatcggcaataccgctgaaggtgtaggatttgccggcttccagataaatcaggcctgacgtcttcgatgccgtgcccgccgcaacgctaccgtcggactgcacattggtgaccgagccactggagttcggtttcccggcgccgtcgatgacgtttttcagcgtggtcgaatccgcgccattgccgttggtgcccaggcccgacagaccggtccagacttccttgatcaggccggtggacttcacgctgttgtcggccacgctcacggtcggcgcatccgccactggcgtgatgtcgattttcacggtgccggtgttgcccagcaactggccgtcggttggctggaacttgatctgcgcgtagtccgcctggttgttgcccagaccgctgccaccgtaaccattgacgcccgactcgttggcatccggcaggaagcgcagcttgcccgcgtcgatgtcagccttgctgaaggtctggttgttggcgacgtctttccaggtcgagccgtccagatactgcagtttgccttcgcccggcagctgggtgattttgatgccgaggctgctggccgggctgtcgacgtcggtcacaccgaaggtcgaccagccaagtaccagcggggtgtcttcggtgccagtgacattgctcggtgcagcaaccggcgcatcgttgatcgccaccacattgaccgtggtggtcgcggtgttggagtagttgccgccatcggtcaccgtcacggtgatgatccgtggcacggtgctcgggttctcactgccgttggtgaagctgatgttcttgatggcctgcatgtagtcggccagtgtcgcgttgcccgacagcgtcagggtcacggtgccgttggtgctgttggcattgatggtgatgccgttgacgctgttgccgaggttcagtgcatcgccgtcctgacggttggtcaggaccacggtggcaccggtgagcatggtgctgtccgggtcggtgatgctgatgtcggtgtcggcaatcgacacgcccgcgcccggggtgttttcggtgaaggtcaccttgtagtcggcaccgctggcgccgctggagttgttggcatccaggtcgagcaccggcggcgcatcgttgtcgatgatcgaagtgctgacgctgccgttggtggcgctgaccgcgaggttttcgaagttgccgcccgtggccgaatcgatcttgaccacgaaattttcggtgccttcggtgatcttgtcgtcgagggtggcgacattgaactgcgcactgctggcaccggccgggatcttcacggtgtacacgccggtgaagtccgaaccgtcggcggcggtgccgctgtagacgattttcagggtcacttcggtttgcgccgggtggttcaggctgacggtgtagctggcggtctggccttcggtcaccgagctgctgccggtgatgctgacggtggtcgtgtcgatggtatcggtgacgctggtcacggctggtgtattgctggtcaccaggttttcgaagccgccgccgctggtgccggtgatgcttgcctgcacgttgccggcgtctttgtagacgtcatcagccggagccgggacggtcacggtgccggtggtttcgccagccttgatggtgatcaccgagccgttgctcagggtcacggtgacgggcgagccagcggcgttggtcagcgtcgcggtgtaggtgatctggccaccttcggccacggtgccggtcgcggacagcgacaggttagtggtgtcgacggtgtcggtcacggtggtgctgaccggggttttgtcggccaccagattttcgtagttaccgccgctcacgttagtgatcgagttggtcagtggagcatgaccagtcaatgcgtcgtttggcgcagtggcggttgcggtgccggtggtctggccaataccaatggtgatggtctggccgttggccagggttacgaccactggcgagccggtcactggagcgccgacagtcgcggtgtagacgacgttgccgccttcagctgcggtgccggttgcggtcagtttcaccgtggtggtgtcgatggtgtcggtgacgctggtcacggctggcgttgtgctggtgacgaggttttcgaagctgccaccggtggcggtcttgatcgttgcctgaacgctgccggcgtctttgtaaacgtcgtccgctggcgctgccacggtgacagtgccggtagttttgccggcttcgatggtgatcacggcgccgttcgacagcgtcacggtgactggtgagccagcggcgttggtcaatgtcgcggtgtagacgatcgagccaccttctgcgaccgagccagtagcgctcagcgacagattggtggtgtcgacggtgtcggtgaccgtggtcgaaaccggggtcttgtcggctacgagattctcgtagttgccgccggtcacgttggtgattgcgttggtcagtggagcatgaccggtcagtgcgtcgtttggcgcaatggcagttgcggtgcccgtggtttggccaacaccaatggtgatggtctgaccgttggccagcgttacaaccaccggcgaacctgtcaccggagcaccaacggtcgcggtgtagacgacattgccgccctctgccgctgtagctgttgccgtcaatttcacggtggtggtgtcgatggtatcggtgacgctggtgacggctggcgctgtactcggcaccaggttttcgaagctgccaccagtggcggtgttgatggttgcctgcacgttgccggcgtctttgtagacgtcgtcggctggcgcagcgacggtcacggtgccggtggttttgccagcgtcgatggtgattacggcgccgtttgacaaggttacggtcactggcgagccagcggcgttggtcaatgtcgcggtgtaggtgatctggccaccttcagccacggtgccggtcgcggacagcgaaagattggtggtgtcgacggtgtcagtgacgttggtcgaaaccggcgtcttgtcggccacgaggttttcgtagttgccgccgctgacgttggtgatcgagttggtcagtggagcatggccagtcaacgcgtcgtttggtgcggtagtggtcgcagtccccgtagtctggccaacaccaatggtgatggtctgaccgttggccagggtcacgacaaccggcgaaccggtgactggcgcgccgacagtcgcggtgtagacaacgttgccgccctcggctgcagttgtggttgcagtgagttttacgatggtggtgtcgatcgtgtcggtgacgcttgtgatagccggcgttgtgctcggcaccaggttttcgaagttgccaccggtggcggtgctgatggtcgcctgcacggtgccggcgtctttgtagacgtcgtcggccggggctggaacggtcacggtgccggtggttttgccggcgtcaatggtgattacggcgccgttggacagcgtcacggtgaccggcgagccagcggcgttggtcaatgtcgcggtgtaaacgattgagccgccttcagccacagaaccggtcgcactgagcgacaggttggtggtgtcgacagtgtcggtcacggtagtgctgaccggggtattgtcagccacgagattctcgtagttgccaccgctgacattggtgatcgcattcgtcagcggtgcgtgaccggccaacacgtcgtttggcgcggtagtggtcgcggtgccggtggtctggccaacaccaatggtgatggtctgaccgttcgacagggttaccacgactggcgagccagtcactggcgcgccgacggttgcggtgtagacgacattaccgccttcagcggcagtggcggtggcagtcagcttcacgatggtggtgtcgatggtgtcggtaacgcttgtgatagccggcgttgtgctcggcaccaggttctcgaagttgccaccggtggcggtgctgatggtcgcctgcacggtgccggcgtctttgtagacgtcgtcggccggggctggaacggtcacggtgccggtggttttgccggcttcgatggtgatcacggcgccgttggacagggttacggtgactggcgagccggctgcgttggtcagggttgcggtgtagacgatcgagccaccttcagcaaccgaaccagacgcgctcagcgacagatttgtggtgtcgacagtgtcggtcacgttggtgctgaccggggtcttgtcggccacgagattttcgtagttaccgccggtcacgttggtgatcgcgttggtcagtggcgcatgaccagtcaatgcatcgtttggcgctgcggtggttgcggtgcccgtggtctggcctacaccgatggtgattgtttgaccgttggccaaagtcacgacaactggcgagccggtaaccggcgcgcctacggtagcggtgtagacgacgttgccgccctctgccgcagtagccgttgccgtcagttttacggtggtggtgtcgatggtatcggtgacgctggtgattgccggcgtcgtactcggcaccagattttcgaagttgccaccggtggcggtgctgatcgtggcctgtacggtgccagcgtctttgtagacgtcatcggctggcgctgcaacggtgacggtgccggtggttttgccggcttcgatggtgatcaccgcaccattgctcagcgtcacggtcactggtgaaccggcagcgttggtcagagtagcggtgtagacgatcgagccaccttcagcgaccgaccccgtcgcactgagcgtcagattggtggtatcgacagtgtcagtgacgttggtcgaaaccggggtcttatcggcaacaaggttctcgtagttgccaccggtcacgctggtaatcgcgttggtcagcggcgcatggccgttcagcgcatcgttcggcgctgtggtggtcgcggtaccggtggtctggccgacgccgatggtgatcgtctgaccgttggccaaggttacgacaaccggcgagccggtgactggcgcgccgacagtggcggtgtaagtgacggtgccgccttcagcgaccgacgtatcagccgtgagtttgacggtcgaggtgtcgatggtatcggtgacttcggtaaccgctggaacagtgcttggcaccaggttctcgaagttgccaccggtgcaggtcagtagcgcgcaatcggcgctgtcgccgttggggttttttgcttgatcagaggcgtcgtcgtggtgttcgtctttttttagcgaggcattgcgcttggcatcccaacgcagctgcaatcggccctttttcacgccggcggcaatgccacgggcggcgaccgacttgtattgatcaacgtatttgatgaacccctcgacgatggcaaacatcgccttcaccaagcgcttcactgctgacagcaattgcgctgcgcgatctgccaggcgtagcgtcagataagcgatccctgcgcccgccccgacgaacgtcagaaccacgccgatcaacacatcgatcagcacctgaacgatcaccatcgacgccgcttcagcagttttcccggcgatctcgctgggcggcaacatctccagccagaggcttgcagtgcgtagcagtaaacagagcgccgcttcgtcactgaccagcaattgcagcttttccatgacgccgtgggccgtcgcagcgagcgccatcaactgcgtggcaccctcgcccaaccgctcggcaaacgccccggggtccttgagaatgtccgagagcagaccaaggctgtcccacacgccttcgatggccgcccagctcccggccagcatgccgttgcccgccgccgtcgccaccgactgcgaccactgtggtttgaaaccctgccattcgctgcgcagccagccttccagctctgcattcaggccgtcataggccgtgaacagctcatcgacttcagcggaggtgaccttgctgtgcacctgcacgcgatagaacttgccgggtattcctatgaatgagccttggccttgcgcatccaaagtgacgggagtggtttcgccaccatccatggcgatcacatcgaccacgatatttcccagcggaatgtcgtagaccgattcaaatttgctctcgagcagcatcggaccgatcttcgggcactgaacgacactggagaagaaatcgtgatcgctgctgctgacggcagtgctgctgtcaccgaagcggaggatccgctccatgcccatcagcgatggcagatccgccgcgtgactgactgtgtccgccgcacggctggcccaatgcttgagctgctcgcggtaaagactgagggtggcgggaaagctgtcgagttcttgctcgatacgggtgacggcttccatcagcgcacgcgggtgtgcggagtggactgaataagcgggtcaaacatgagcgttccctcgcgcaaaaattaggcgcgggaactgtgcgggggatcaatcaggaaagaagtcaggcaagtaggtgatggctgtaggacttatctgtaaaagctactcacataaaaaacaggcaggcgaaaacgcaaacgtggcaggaggtttccttcacgccacgttcatcaaacagacaagcagatattcaatgcgcagaacgtttgctactcaacgccgcgcgagcccagctctttcagcttgagctcggccaatgggtgcccggccttggcagccattctccaccagcgagcagcttcatccgggtcaggcgccttgctcggcgtacctgcgaggctgatcacgccaacctgataggccgctttgccatcacccgccaaagccgccaggcgcaataatcgcacaccttcctcgcgtgcccccaggcccacaccgcgaaacgtcaggatgtgcccataaaagctctgcgcaccgacatcgcctaggttggccatgcgcgcaaactgaccttcaagccagcgccagccacgcggctggcggacaaaccacgaccagtgaaacagccggcgagccagccagtaactggcccgcgccttgagtcgtagcaacactcaggcctccgccgattccgggtactcgtattcaaaaacccggacaacttccgacgcatgccaagaggcggcggcgacaccatcggacggaccggaaaaacgcccgagacgttcgacacattcaaaaaaaccggtacgcggcaggcgactggcaccttggctgatgaccagtgagctgcgcagtggttgttcggccttggcgtccagtgcggccagatgttcaagcgccgcggtcagcgtctgcatcgccggcgtcggcaattgcaggcgttcgagcagcgcccgataagtcagcagatggcgctgacggcgcgcctgatccagttctcccagcaatccgtcccaatgctgacgactgatgcgtacgctcacgattcatccctccaacctggcaccgtcaactcccaggccaggctgcgacgaatcgcggcgtcgggctgacgctcgccactttcgatcatggccagataagacgggctgatgcctaccgtgcgggccagcgcctcgatggcgatgcccttcccttcgcgcaaactgcgtaattgatccagaccaggaagtatcgggtctgatgatgtcgcgacaggcgctggagccgggcgcgacggtgtttcgttgagacctgctgctttcagtagagcctgatattgagcccaaggcagaaccgcgtattccggttcgccatcgcgtgcaattatctgaatatccatgactaccccgtaggacaacaacacttagcgagtcggcacttttccctagaagtgtaatcctaacagcggctaaggtcgcgggggcatctatctgtgaaagggactacaacaatcagggctttttcgggccctgaagttgaagttgttcaggggtatcgggcaggcgctcgaccacagcgagtttttccggctgctggcggttgcgccagatgcggaaggcgttgagctcatcgtcgagggttttcatcagccaggcgaggacggcaatgtcgtcgagcataccgaataccgggatgaaatcaggaatggcatcgaccgggctgaggaaatacatcaatcccgccaccaccgaaaccagcgctttgccgctgatggcgcggtactcgccccgccagtacgccaggcacaatgcctgcagcagacgcagatcatctttgagtttgccgagtcgattaccttgcgcggcacctttgctggccacggcgaacagcagcgtcggtaaacgtccacgggcaagcaatcggccagccaagggcaggaatcgagcgaaattccacggagctttcatctattcctcccgttgaaatgttatccacacaaattgtggataaccttgtgaacagagctgcatttgtgcgctgagagccccgttttataagggccgcgctcagatcgggcgttttttactcacataaaaaaccccaatatttcattgacttggcggctcagggcgtctaccgcggggcagcctcaaagctatgactcctctgaccggcgtcggttcgctctgtttacccttgccaacctccagatgcaacaacgccccgcataagcgaggcgttgttgttgaaaccgagaccgattacttggcggcagcggcgtcttctttggctggatccttgatggccaacagttccaggtcgaagaccagaaccgagttggccgggattgccgggcttggcgactgagcgccgtaagccagatcgctagggatgtacagtttgtacttctcgccaacgtgcatcagttgcaggccttcgacccaacccgggatcacgccgcttaccggcagatcgatcgggctgccgcgctcgacggaactgtcgaatacggtgccgttggtcagcttgccggtgtagtgaacggtcactacgtcggtaggcttaggctgtgggccgtcggctttcttgaccacttcgtattgcaggccggaagcagtcgtcgttacgcctgctttcttgccgttctcttcgaggaatttcttgccggcggctgccgactcttcgctcatcttggccatgcgctcttcagcacgcttttgcagcgcggcgaaggcttcgaccagttcttcgtctttcagcttctgttctttcttgccgacggcatcttcgatgccctgggctaccgctttggagtccagatcatccatgccttcctgagcaaggctcttgcccatgttcaggccgataccgtaggaagctttttgcgccggggttttcagctctacgctggtctgcgaatcacaacccgcgaggaccaggctaaccagggcaaccgccgccgccaaccgatgctgtttcatgctatttccttgttcatgcgccgaaagggcaatcgagtaaagccgcgagcttatcaggccgccacgaccaatggctaccggcatgagagcaggaatcttccgataagttcagggattaaaacgcatttgggcaaaggcgcgatgaagcttctgtcatctatgcctgacaagacttcccatgtcatctggcgtaatggccacttgcccagcatggccccgctcaggcataacagcgcaacaattcgacaaggatgtttatcttgcgcctcttattccgtgtgctgaccctgatcgtggtgctgctggggctcgtcctggtggtgattctgtactacgtcgccaacccgaaattgcccttctacacccccgcccagcaggtgcattacctgaatcagtggagtgaagaagaacggcaaacctactatttcacgccgcagggtacgcaggtcaaaggcttgcgctatgaatggtttcaggcgctggagttgccgttttccgagcagcgattcgcctctcccgactaccttgcccgcttcggctttctcgtcgatccgcaacagaaagccacgccgaacaatcccggcaacctgcctgtcggctttgcccgacatcagaatcccggcagtcccgagcaatatctggacataacttgtgcggcttgccacaccggcgaattgcgcttcaaaggccaagccatacgcgttgatggcggtgcggcgcagcatgtgctgccttccagcgttcctacactgcgtggtggtagtttcggacaggcactggtcgccagtctgacctcaacctacttcaatccctggaaattcgaacgcttcgctcgaaacgtcttgggtgatgagtacgatgcgcgccacgggcaactgcgcaaggatttcaaaggctcactggacaccttcctgaaagtcgcctggaacgacacccatcgcggcctctacccgaccgaagaaggccccggccgtaccgacgcgttcggacggatcgccaatgcgacgttcggcgatgccatctcccctgccaactaccgcgttgccaatgcaccggtggattacccgcagttgtgggacatgtggactttcgactgggtgcaatggaacggctcggcgcagcagccgatggcgcgcaatatcggtgaggcattgggcgtaggcgctaccctgaatttcttcgacgccgacggccagccgctgcaaggcgatgagcgctatgcctccagcgtgcgcgtgcgtgatctgcacaagattgaggaaaccctgcaaaagcttcagccgcccgcctggccggaagatttgctgggcgttgtcgatagacccctggccgccaaaggtcgcacgttgttcagcgagaattgcgccggatgccacgtcccgcgggcaacccgtgagggcgaccgctgggtgcaacacctgcacatgctccccgttgatgtcatcggcacagaccccaatgcagccaccaatatcgcgactcaccgcttcgatctgacggcactgcaatgggatttgcaagaactgaagaatatggacgtcaagctgcatccagagcccaaagaaccgttggatctgagccagctatcagtcgccaagggactggcttacgtcaccgcattcgtcgaaaaccgcgcctaccgcgaagccaaggttacgccggaagaaaagccagacctcgatggctttggcctgccgattggcgtgcgcgaaaaagtcgcctacaaggcacggccattggccggtgtctgggccactgcgccgtttttgcacaacggctcggtgccgactatttaccagttgctctcaccacaggatgaacgcgcaaccaccttctataaaggcacgttcgaatacgaaccacggcatctgggttatcgcaccgaagcattccctaatggctttctgttcgatacgcggatcagcggcaaccacaacagcggtcatgaattccgcgtcggcgagcgcggtaacggcgtcatcggccgactgctgcaaccggaggaacgctgggcgttgctggaatacctgaaagtcctcggcggcccactggaggcgcaattgccatgatcctgccaaccttcaagaaagaactgccgatactcgcccgaatctggttgtggctcgggcgtttactcggcaaaacactgttgattatgctcgccatcggcctgctcggctgggcagtcgccaccgcgtggtttgcctggcaacagcgcggcccggtgtcggcaaccgaacagattccatctggcgaagcggcgatgacccaagacgtgatccagaccgccgtgcgcatcgtcgatcaacaccgcgaacccacacggtatttgcgcgacgcgcatgccaaggcccatggctgtgtaaaggctgaggtccaggtcttacctcagttggcgcagtcgctgcgacagggcgttttcagcgaaccggggacaacctggcaagcgatgattcgcctgtccaacggcaatgcttacccgcaattcgacagcattcgcgacgcccgtggcatggcgatcagattgctggacgtgccgggtaaacagctacttggcgaacgcgcgcagcggcgtgaacaggattttgtcatgttcagccatccgaacttctttgtcagtgatgtcgccgagtaccgtcagaatgtggctgctcaagctgacggtaaaaaggtcatggcgttttttccgggctgggatccacgcacctggcagatccgccatttgtttatcgccttggccaccctgtcgtcgccgccggacagtccgacggcgacgacctacttttcggtctcgccctacaaattcggtgacgccaatgcgaagtttcgggtgatgccggatccggcccgctgcccggcctacacgctaccgaaacagaaccacgacttgccgaacttcctgcgcagcgctctcagtcagcagttgtcggcggatcgagtgccggcgtgttttgtcctgcagatccagcgtcaggatgcgaaccggtacatgccgatcgaagacaccagtattgaatggcgtgagcaggactcaccgttcgagaccgtggcgcggattaccttgccaccacaggacttcgattcgcctgcgctgaatctggcgtgtgacaacctgtcgttcaatccgtggttcggcattgaagcgcatcggccgattggcgggatcaatcgtctgcgcaaagcggtgtatgaggcggtgagtgattatcggcatagccggaatgccctgtaggagctgtcgagtgcaacgaggctgcgatcttttgatcttaggaaagcaggatcaaaagatcgcagcgtgccgtagctcctacaggggctcaggtgattttctcaaaccccggacagcaaaaagcccgcactaggcgggctttctgtggaatctggcgttcagtgttccagattccgaatatggcgcagcggacgggactcgaacccgcgacccccggcgtgacaggccaaaacaaaaccccaactgctttcgcaattggggtttcggaatttaatcttgacgatgacctactctcacatggggaaaccccacactaccatcggcgatgcatcgtttcactgctgagttcgggatgggatcaggtggttccaacgctctatggtcgtcaagaaattcgggtactgagtcgtgaccttctggtctcgcttcagcaaattgggtatgtgacagctggtgttttgtgaacatcgaactttcggttcgtttcgtcttcacacaccgcaatctggtctctctcgcttttcagctcggagcatgcaaattgcttgggtgttatatggtcaagcctcacgggcaattagtattggttagctcaacgcctcacagcgcttacacacccaacctatcaacgtcgtagtcttcgacggcccttcagggaactcaaggttccagtgagatctcatcttgaggcaagtttcccgcttagatgctttcagcggttatctttcccgaacatagctacccggcaatgccactggcgtgacaaccggaacaccagaggttcgtccactccggtcctctcgtactaggagcagcccctctcaaatctcaaacgtccacggcagatagggaccgaactgtctcacgacgttctaaacccagctcgcgtaccactttaaatggcgaacagccatacccttgggaccggcttcagccccaggatgtgatgagccgacatcgaggtgccaaacaccgccgtcgatatgaactcttgggcggtatcagcctgttatccccggagtaccttttatccgttgagcgatggcccttccatacagaaccaccggatcactaagacctactttcgtacctgctcgacgtgtctgtctcgcagtcaagcgcgcttttgcctttatactctacgaccgatttccgaccggtctgagcgcaccttcgtactcctccgttactctttaggaggagaccgccccagtcaaactacccaccatacactgtcctcgatccggataacggacctgagttagaacctcaaagttgccagggtggtatttcaaggatggctccacgcgaactggcgtccacgcttcaaagcctcccacctatcctacacaagcaaattcaaagtccagtgcaaagctatagtaaaggttcacggggtctttccgtctagccgcggatacactgcatcttcacagcgatttcaatttcactgagtctcgggtggagacagcgccgccatcgttacgccattcgtgcaggtcggaacttacccgacaaggaatttcgctaccttaggaccgttatagttacggccgccgtttaccggggcttcgatcaagagcttcgcgttagctaaccccatcaattaaccttccggcaccgggcaggcgtcacaccctatacgtccactttcgtgtttgcagagtgctgtgtttttaataaacagtcgcagcggcctggtatcttcgaccggcatgagcttacggagcaagtccttcaccctcaccggcgcaccttctcccgaagttacggtgccattttgcctagttccttcacccgagttctctcaagcgccttggtattctctacccaaccacctgtgtcggtttggggtacggttcctggttacctgaagcttagaagcttttcttggaagcatggcatcaaccacttcgtgttctaaaagaacactcgtcatcagctctcggccttagaatcccggatttacctaagattccagcctaccaccttaaacttggacaaccaacgccaagctggcctagccttctccgtccctccatcgcaataaccagaagtacaggaatattaacctgttttccatcgactacgcttttcagcctcgccttagggaccgactaaccctgcgtcgattaacgttgcgcaggaaaccttggtctttcggcgtgggtgtttttcacacccattgtcgttactcatgtcagcattcgcacttctgatacctccagcaagcttctcaactcaccttcacaggcttacagaacgctcctctaccgcatcacccgaaggtgatacccgtagcttcggtgtatggtttgagccccgttacatcttccgcgcaggccgactcgactagtgagctattacgctttctttaaagggtggctgcttctaagccaacctcctagctgtctaagccttcccacatcgtttcccacttaaccataactttgggaccttagctgacggtctgggttgtttcccttttcacgacggacgttagcacccgccgtgtgtctcccatgctcggcacttgtaggtattcggagtttgcatcggtttggtaagtcgggatgaccccctagccgaaacagtgctctaccccctacagtgatacatgaggcgctacctaaatagctttcgaggagaaccagctatctccgagcttgattagcctttcactccgatccacaggtcatccgctaacttttcaacggtagtcggttcggtcctccagttagtgttacccaaccttcaacctgcccatggatagatcgcccggtttcgggtctattcccagcgactagacgccctattaagactcgctttcgctacgcctcccctattcggttaagctcgccactgaaaataagtcgctgacccattatacaaaaggtacgcagtcacccaacaaagtgggctcccactgcttgtacgcatacggtttcaggatctatttcactcccctctccggggttcttttcgcctttccctcacggtactagttcactatcggtcagtcagtagtatttagccttggaggatggtccccccatattcagacaaagtttctcgtgctccgtcctactcgatttcatgactaagagattttcgcgtacagggctatcacccactatggccgcactttccagagcgttccgctaatctcaaagccacttaagggctagtccccgttcgctcgccactactaagggaatctcggttgatttcttttcctcagggtacttagatgtttcagttcccctggttcgcctcttgcacctatgtattcagtacaagataaccatcttatgatggctgggttcccccattcagacatctccggatcaaagtctgtttgccgactccccgaagcttttcgcaggctaccacgtctttcatcgcctctgactgccaaggcatccaccgtatgcgcttcttcacttgaccatataaccccaagcaatctggttatactgtgaagacgacattcgccgaaaattcgaatttctcaattaagagaactcacaaattttaccttagcctgatccgttaccagtgaaagtaacgttcagtctatctttctatcacatacccaaatttttaaagaacgaactagtcaaagactagaaatcaacattcaccatcacaacgatggaatgctcatttctaagctttatacttcagaagcagtagtggtggagccaaacgggatcgaaccgttgacctcctgcgtgcaaggcaggcgctctcccagctgagctatggccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtcttcttcaatgaatcaagcaattcgtgtgggaacttatggagcagctgatgtcgtcgattaaggaggtgatccagccgcaggttcccctacggctaccttgttacgacttcaccccagtcatgaatcacaccgtggtaaccgtcctcccgaaggttagactagctacttctggtgcaacccactcccatggtgtgacgggcggtgtgtacaaggcccgggaacgtattcaccgtgacattctgattcacgattactagcgattccgacttcacgcagtcgagttgcagactgcgatccggactacgatcggttttatgggattagctccacctcgcggcttggcaaccctttgtaccgaccattgtagcacgtgtgtagcccaggccgtaagggccatgatgacttgacgtcatccccaccttcctccggtttgtcaccggcagtctccttagagtgcccaccattacgtgctggtaactaaggacaagggttgcgctcgttacgggacttaacccaacatctcacgacacgagctgacgacagccatgcagcacctgtctcaatgttcccgaaggcaccaatccatctctggaaagttcattggatgtcaaggcctggtaaggttcttcgcgttgcttcgaattaaaccacatgctccaccgcttgtgcgggcccccgtcaattcatttgagttttaaccttgcggccgtactccccaggcggtcaacttaatgcgttagctgcgccactaagagctcaaggctcccaacggctagttgacatcgtttacggcgtggactaccagggtatctaatcctgtttgctccccacgctttcgcacctcagtgtcagtatcagtccaggtggtcgccttcgccactggtgttccttcctatatctacgcatttcaccgctacacaggaaattccaccaccctctaccatactctagctcgccagttttggatgcagttcccaggttgagcccggggatttcacattcaacttaacgaaccacctacgcgcgctttacgcccagtaattccgattaacgcttgcaccctctgtattaccgcggctgctggcacagagttagccggtgcttattctgtcggtaacgtcaaaacagcaaagtattaatttactgcccttcctcccaacttaaagtgctttacaatccgaagaccttcttcacacacgcggcatggctggatcaggctttcgcccattgtccaatattccccactgctgcctcccgtaggagtctggaccgtgtctcagttccagtgtgactgatcatcctctcagaccagttacggatcgtcgccttggtgagccattacctcaccaactagctaatccgacctaggctcatctgatagcgcaaggcccgaaggtcccctgctttctcccgtaggacgtatgcggtattagcgttcctttcgaaacgttgtcccccactaccaggcagattcctaggcattactcacccgtccgccgctgaatccaggagcaagctcctctcatccgctcgacttgcatgtgttaggcctgccgccagcgttcaatctgagccatgatcaaactcttcagttcaaacatctttgggtttttaagaaaccctaaacttggctcagcaatcgttggttacatctttgatttctcgcggagtaacttgtgatgctgataatcttgttgactatcagtctgactccacaagcacccacacgaattgcttgattcagttgttaaagagcggttggttaagatctttcgtctcaaccgaggcgcgcattctacagcagcctcatttgctgtcaagtgattattttcagaagcaaccccaacggatccacccaccccgtcggattcggcacgtactggtactgattcaacccacccgccagcttgatgggatccggcgtcagataccttcccaaccgcgggtcgtaataccggtgccggttgtaatgcagcccactctccgcatcgaaatactgcccctgaaaccgcagcggctgatcgaggtattccgccgctgccaagctcagcgcggcgactttgccgtaggcgtcgtactgcgcagcccagacgatttctccgctgtaatccgtgagttccagcggggtgccgaggtggtcgagttggtaatagaacgggcaggcctttttcgggcctttgccgtcgagcagcgccagcgggcggaaggtgccgggttcgtagacgtagctgcggtattcgctcgggctgctttcggcgacgaggttgtcgccctgccagaaaaattcggttatctggccgttgacggttttgcggatgcgccggccgaaggcgtcgtattggtaacttgcggtctggccgtccggtcgggtcaggccgatcaggcggtgctggctgtcgtagcggtattcgctgacgagtttttgcgcggtgccacggcgttcgcggatcaggttgccgaaggcgtcgtagtcgtaatgccggtcaccctgcatcagcaggcgattgcccgtgatctgactggggccggggcggtcctgcatcaacaggttgccggccgggtcgtgggcaaaggattccggcagttcgtcgcgcgaatggcgcacgcggatcagccggtcaagggcgtcgtaggcgtaggtgcgctggccgtggcgggtgtcggcgatgtgttccagattgccgttggcgctgtaggcatagtcgcggcggtacagcgcatcgtgggaatggcctactgcatgggcgagcaatcggccctgatcgtcgtaagaatattcgctgagcagcaggccttgctggcgttgttgttcacgcccggattgaaagacatgcgtggtcagttgcgcgccgttgaggtcgatgccggtcagcgcgccgcccttggcgtagtggtaatcgagcttgctgttgtccggcaggcgcaggcgtttgagctgaccgcaggcgtcatagctataacgcagcgtgccccagccctgatgctcggtgatcagtcgatcctgacggtcgtactcgaaggccagcggatggttctggccgtcatggacgccggtcaaacgaccgaggcggtcgtattgatagctgaccttgaccccgtccggcagggttttgaccaacaggcgcccggcgctgtcgcgtgcatacgccgtgaccagctgcgagccgtcatcgccgtattcggttttctccagcagatggccgttgaggtcgtaggcatacgcggtgcgccgcccgtcgaagccggtttcctggcggatcagtccggtcggcgtgtagtccagccgatacttctcgccggactcgttttcaatctcggtgagcaacaactgcgcatggtcgtagcggtactgcacccgcgtgccgtcggggttgatccgccgcgagaccaggtgcagatcgtcgtcatattcataacgggtgatgcgccccagttcatcgcgttcggcagtgatctgaccgtaagcgccgtagctgcaagcgcgagtagcgccgcccggcaacgtcgtctgagccagccgacccgccgcgtcccactgttgacgggtcaccgcaccatgttcgtctacggtggtggtccgccgccccaacgcgtcgtaggaaaagtgccgtacgccaccgtcaggcaatgtctcttcaatgagctgaccgaggtcattccacgccagccgaatccggctgctgtccgggtaacggatcgacagcagttgcccgcgtacgtcgtagtagtaatgcgtgaccttgccgtcgggatcgactgcttcggtgacatcgccctcggcattgcgccgatagagccacaccgcatcaaggcgtgaacgccggtagaggaaaccgttgcggtactcgtaggacgttggcgcgtcatccggcggaatcagcgcgatcagccgtccgacttcgtcgtagcggtattcggtgacggcgcctaacgcatcctgctcggcgaccaagcgcccggcatcgtcataggccttgagctgctcgccgccatcggcctcgaccttgcgcaccagccgcgctcgatcgtcgtggacgtaaacctcttcggtgccatcgacgtaatgcaccgtgacactgccgtcgtcgccccagacgtaacgggtgttcatctgcgagaacgaggcccagtgccttacgcagcgcgccgatttgcccgagcgctcccacgcccagaagaaactcgcgccaccagccagttgccgctgcaaaatgacgtgggtgtcatcgtagtcataacgctcaaccagcggcgttggtcagggtggcggtgtaaacaatcgaaccaccttcggccacagagccggtcgcgctgagcgacaggttggtggtgtcgacggtgtcggtcacgttggtgctgaccggcgttttatcggccacgagactttcgtagttgccgccagtgacacccgtgatcgagttggtcagcggcgcgtgaccggtcagcgcatcgttcggtgcggtgaaggtcacggtgccggtggttttgccgacttcgatggtgatgttctgaccattggccagagtcaccacgacaggcgagccggtcactggagcgccgacagtggcggtgtaagtgacggtgccgccttctgccacggaggtgtcggccgtgagtttgacggtcgaggtgtcgatggtatcggtgacttcggtcacggccggaacagtgctcggcacgaggttttcgaagttgccaccggtagcggtggagatcgtcgcttcaaccttgccggcgtctttgtagacgtcatcggctggcgctggaacagacacggtgccggtggttttaccggcctcgatggtgatcacagcgccgttcgacagggtcacggtgactggcgagccagccgcgttggtcagcgtcgcggtgtagatgatcgaaccgccttcagccacggtgccggttgcagtcagcgacaggttagtggtgtcgacggtatcagtgacattggtcgaaaccggcgtcttgtccgccaccagattttcgaagttgccgccgcttacctcggtgatcgcattggtgatcggcgcgtggccggtcaatgcatcgttcggcgcggtggtggtcgcggtgccggtggtctggccaacaccaatggtgatggtctgaccgttagccagggtgacgaccacaggcgaacccgtgactggcgcacccaccgtcgcggtgtaagtgacggtgccgccttcagccacggaggtatcggccgtcagtttcacggtcgaggtgtcgatggtgtcagtcacttcggtaaccgctggaacagtgcttggcaccaggttctcgaagttgccaccggtggcggtcgaaatggttgcttcgactttgccggcgtctttgtagacgtcatccgccggagctggaacagacacggtgccagtggttttaccggcctcgatggtgatcacggcaccgttcgacagggtcacggtgactggcgaaccagcggcgttggtcagcgtggcggtgtaaacaatcgaaccgccctcggccacagagccggtcgcgctgagcgacaggttggtggtgtcgacggtgtcggtcacgttggtgctgaccggcgttttatcggccacgagactttcgtagttgccgccagtgacacccgtgatcgagttggtcagcggcgcgtgaccggtcagcgcatcgttcggtgcggtgaaggtcacggtgccggtggttttgccgacttcgatggtgatgttctgaccgtttgacagggtgacgaccacaggcgaaccagtaactggcgcacccaccgtcgcggtgtaagtgacggtgccgccttcagccacggagggggagtgtatgtaccggacacatggtggacgggtgttcggagacatggtggacactttttaatagacacattgctcatcaccaaggagatgacctgtgtcctgggaagaggtgtccaccgtgcagcttcgttcagaattcgtgcttttggctcggcaagaaggggccaatgttcggcagctttgccgtcgattcaatatcagcccaagcactgcctacaaatggctcaacaggtttgaaaatctcggtgcgcaagggttgatcgatcagtctcgacgaccaaagacgtcacccaaacgctgcgctgaagaggttgagcagcagattttgaccgtgagtcaggagtacgccgcttggggcgctcgcaagctcaagcgcgtgttggaagacgacggcaaagtgatgccctctgtcagcaccgtgcatgcggttttacagcgtcattcgcgcgttgacccaaaggctgccgaggtcaaaccgtttatccggttcgagcacgaggcgcccaacgatctttggcaaatcgacttcaagggtcatatcagcctgaaccacggacgttgccatccgctgacgatactggacgatcactcgcggttctcactgtgcatcgctgcatgcgccaatgagcagcgccgaaccgtccaggagcaactaatgcgggcctttcggctctacggtctgcctctgcgcatgacgatggacaacggttcgccatggggtgaccagaccggcgtttataccgcgctggaggtctggctgatgagccagggcatcaaggtcggccactctcgtccttatcatccgcaaacccaaggaaagctggagcgcttccaccgcagcctgaaaagggaagtcctgcaaggccagctcttcatcgatctggacgacgcacaacgggcgtttgatatctggcgtgagatttacaaccagaagcgcccgcatcaagcactgggcatgcaggttcctgctactcgctacagcagcagcccgcgggaatatcaggagcaaccgacggcgcctgagtacgacgatggggatgtggtcaggaaggttcaagtgaagggcgagatctactggggcaaccgtgaatacaccgtcggaaaggcgttttacgggagatcagtggctatccgggaaacgacggaggatggcatccacgatgtctactggagtagacatcgcatcgcccgaatcgacttgaacttgcagatcgtcacggcaggtaagaagatctaaaaccgtccaccatgtctccgaacatgtgtccaccatgtctccggtacatacagggagagggctagggtgagggtcagcgcccgccccgacctgaagctcgaagaactcctgcacaaacccggcgtgctgaccttcggcgccaccggcgaaggcacgatccacggcctggtctatcgcatcgagcaaggcgattccggcaagaccctgactcgctacagcctcagcctggtgccgcaactcgcctacctgcgccacaaccacgatcagcagattttccagcaactgacggtgccgcaaatcatcggccaggtcctggaagatcgcggcatcctcgccgacgcctacgatttccagctcagcgccgagtacccgcagcgcgattattgcgtgcagtacgacgagtccgacctgcacttcatccagcgcctgtgcgaagaggaaggcattcactttcacttccagcacagtagcagcgggcacaaactggtgttcggcgatgaccagacggttttccgcaaactcaaagcggtgagctaccagcaagactccggcatgagcgccgacaaaccggtgatcaagcgcttcaacctgcgcctggaaacccgcaccacccgcgtcagccgccgcgattacgacttcgaaaaaccgaaaatcctccccgaaggcgcagttaaatccgacttcgccccggatctggaggactacgactaccccggccgtttcaccacccgcgagcgcggcaaattcctctccacccgcgccctcgaacgccatcgcagcgactacaaactcgccgaaggcaaaggtgacgaaccgaccctgaccagcggccatttcctcaccctggccgagcacccgcgcgccgaatggaatgatctgtggctgctgctggaagtcttccacgaaggcaaacaaccgcaagtgctcggcgaaaacgtcaccagcgacgtcaccgaccacaaaagcgatttccaccagggctaccgcaacagcttcctcgccaccccgtgggacgcgcactaccgccctgccctcgaacacccgaaaccgaaagtgctcggcagccagaccgctgtggtcaccggccccgcaggcgatgaaatccactgcgaccaatacggccgcatcaaagtgcaattccactgggaccgcgaaggtcagtccaacgacaaaaccacctgctggatgcgcgtcgccagcggctgggccggcgcagcctatggcggcatcgccatcccgcgcatcggcatggaagtcctcgtcactttccttgaaggcgatcccgatcagccactggtcactggttgcctgtaccacaaggaaaacgtcgttccctacgacctgccggcaaacaaaacccgcagcaccttcaaaaccctctggaagtcgctgcggtggcgttcgagggcgcgtttggccaggtgcttgccgcgttcgcggtcgatgaaacgacccggatagtcgtaatcttcgaggtcgggcagggcgtcgccgcggttctcgctttcgagggtaatgcgcggtttttcgaagtcgtaatcgcgccgcgtggtgcggctggtgcgtgtttccaggcgcaggtcgaagcgcttgatcaccgggtcgctggcgaccatgccggagtcttgctgataggccaccggcgccagtttcgggaacaccgtctggtcatcgccgaataccagtttgtgcgccgttgccgtgtgctcgaagtggtagtgaataccttcttcttcgcacagacgctggatgaaatgcaggtccgattcatcgtattgcacgcagtagacgcgctcgggataaatcgaaccggtcttgaattcgtaggcgttgctttgaatgccgtgctcttcgaggacttggccgatgattttcggcaccgtgaggttctggaagatgcgctggttgacgcggtgcgccaggtaggacaattgcgggcgcagggtcaccgaataacgggtcaggcgtttgcccgagtcgccttgcgcggcgcggtaaatctggccgtgaatgccgctgccgtcgggcgacagttgcaggaaggccggtttgtgcagcagggtttcgaggtccagcgatggctgctcactgaccagctccacctcaaagacaaaaggctggctgatggcttcgcgaccttgcagggtgaatacctgaaagtcagcagaaagaccttcgatggtcagggcaaagtgagtttcattggccggcgcgaacatcccttgttcct
